US009580476B2

(12) United States Patent
Brough et al.

(10) Patent No.: US 9,580,476 B2
(45) Date of Patent: *Feb. 28, 2017

(54) ADENOVIRAL VECTOR-BASED RESPIRATORY SYNCYTIAL VIRUS (RSV) VACCINE

(71) Applicant: GenVec, Inc., Gaithersburg, MD (US)

(72) Inventors: Douglas E. Brough, Gaithersburg, MD (US); Jason G. D. Gall, Germantown, MD (US); Duncan McVey, Derwood, MD (US)

(73) Assignee: GenVec, Inc., Gaithersburg, MD (US)

( * ) Notice: Subject to any disclaimer, the term of this patent is extended or adjusted under 35 U.S.C. 154(b) by 52 days.

This patent is subject to a terminal disclaimer.

(21) Appl. No.: 14/349,735

(22) PCT Filed: Oct. 5, 2012

(86) PCT No.: PCT/US2012/059043
§ 371 (c)(1),
(2) Date: Apr. 4, 2014

(87) PCT Pub. No.: WO2013/052859
PCT Pub. Date: Apr. 11, 2013

(65) Prior Publication Data
US 2014/0271711 A1    Sep. 18, 2014

Related U.S. Application Data

(60) Provisional application No. 61/543,495, filed on Oct. 5, 2011, provisional application No. 61/543,506, filed on Oct. 5, 2011, provisional application No. 61/543,520, filed on Oct. 5, 2011.

(51) Int. Cl.
*C07K 14/005* (2006.01)
*C12N 15/86* (2006.01)

(52) U.S. Cl.
CPC ............ *C07K 14/005* (2013.01); *C12N 15/86* (2013.01); *C12N 2710/10322* (2013.01); *C12N 2710/10333* (2013.01); *C12N 2710/10343* (2013.01); *C12N 2760/18034* (2013.01); *C12N 2799/022* (2013.01)

(58) Field of Classification Search
None
See application file for complete search history.

(56) References Cited

U.S. PATENT DOCUMENTS

| | | | |
|---|---|---|---|
| 5,837,511 A | 11/1998 | Falck-Pedersen et al. | |
| 5,851,806 A | 12/1998 | Kovesdi et al. | |
| 5,994,106 A | 11/1999 | Kovesdi et al. | |
| 5,994,128 A | 11/1999 | Fallaux et al. | |
| 5,998,205 A | 12/1999 | Hallenbeck et al. | |
| 6,033,908 A | 3/2000 | Bout et al. | |
| 6,127,175 A | 10/2000 | Vigne et al. | |
| 6,225,289 B1 | 5/2001 | Kovesdi et al. | |
| 6,482,616 B1 | 11/2002 | Kovesdi et al. | |
| 6,514,943 B2 | 2/2003 | Kovesdi et al. | |
| 6,677,156 B2 | 1/2004 | Brough et al. | |
| 6,682,929 B2 | 1/2004 | Brough et al. | |
| 7,195,896 B2 | 3/2007 | Kovesdi et al. | |
| 2004/0136963 A1 | 7/2004 | Wilson et al. | |
| 2008/0233650 A1 | 9/2008 | Gall et al. | |
| 2015/0140025 A1 | 5/2015 | Wei et al. | |

FOREIGN PATENT DOCUMENTS

| | | |
|---|---|---|
| WO | WO 94/28152 A1 | 12/1994 |
| WO | WO 95/02697 A2 | 1/1995 |
| WO | WO 95/16772 A1 | 6/1995 |
| WO | WO 95/34671 A1 | 12/1995 |
| WO | WO 96/22378 A1 | 7/1996 |
| WO | WO 97/00326 A1 | 1/1997 |
| WO | WO 97/12986 A2 | 4/1997 |
| WO | WO 97/21826 A2 | 6/1997 |
| WO | WO 00/00628 A1 | 1/2000 |
| WO | WO 00/34444 A2 | 6/2000 |
| WO | WO 03/020879 A2 | 3/2003 |
| WO | WO 03/022311 A1 | 3/2003 |
| WO | WO 2010/051367 A1 | 5/2010 |
| WO | WO 2011/057248 A2 | 5/2011 |
| WO | WO 2012/021730 A2 | 2/2012 |

OTHER PUBLICATIONS

Altschul et al., "Basic Local Alignment Search Tool," *J. Molecular Biol.*, 215(3): 403-410 (1990).
Altschul et al., "Gapped BLAST and PSI-BLAST: a new generation of protein database search programs," *Nucleic Acids Res.*, 25(17): 3389-3402 (1997).
Bai et al., "Mutations that alter an Arg-Gly-Asp (RGD) sequence in the adenovirus type 2 penton base protein abolish its cell-rounding activity and delay virus reproduction in flat cells," *J. Virol.*, 67(9): 5198-5205 (1993).
Biegert et al., "Sequence context-specific profiles for homology searching," *Proc. Natl. Acad. Sci. USA*, 106(10): 3770-3775 (2009).
Boulanger et al., "Characterization of adenovirus protein IX," *J. Gen. Virol.*, 44(3): 783-800 (1979).
Brough et al., "Activation of transgene expression by early region 4 is responsible for a high level of persistent transgene expression from adenovirus vectors in vivo," *J. Virol.*, 71(12): 9206-9213 (1997).

(Continued)

*Primary Examiner* — Shanon A Foley
*Assistant Examiner* — Myron Hill
(74) *Attorney, Agent, or Firm* — Leydig, Voit & Mayer, Ltd.

(57) ABSTRACT

The invention provides an adenovirus or adenoviral vector characterized by comprising a nucleic acid sequence encoding one or more Respiratory Syncytial Virus (RSV) antigens and one or more particular nucleic acid sequences or one or more particular amino acid sequences, or portions thereof, pertaining to, for example, an adenoviral pIX protein, DNA polymerase protein, penton protein, hexon protein, and/or fiber protein, as well as a method of inducing an immune response against RSV in a mammal by administering the adenovirus or adenoviral vector to the mammal.

14 Claims, 9 Drawing Sheets

(56) References Cited

OTHER PUBLICATIONS

Figure 1A:
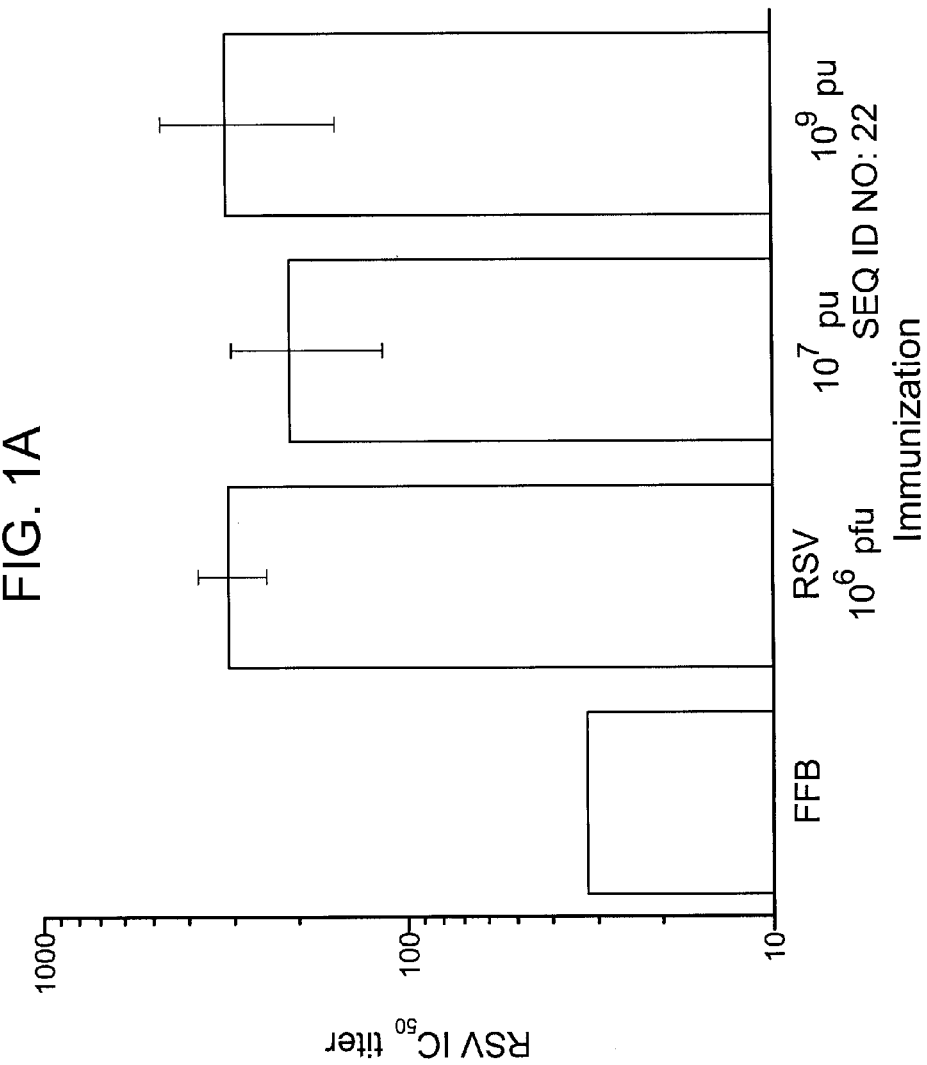

Cartier et al., "Hematopoietic stem cell gene therapy with a lentiviral vector in X-linked adrenoleukodystrophy," *Science*, 326(5954): 818-823 (2009).
Cavazzana-Calvo et al., "Gene therapy of human severe combined immunodeficiency (SCID)-X1 disease," *Science*, 288(5466): 669-672 (2000).
Chen et al., "Persistence in muscle of an adenoviral vector that lacks all viral genes," *Proc. Natl. Acad. Sci. USA*, 94(5): 1645-1650 (1997).
Chroboczek et al., "The sequence of the genome of adenovirus type 5 and its comparison with the genome of adenovirus type 2," *Virology*, 186(1): 280-285 (1992).
Crawford-Miksza et al., "Analysis of 15 adenovirus hexon proteins reveals the location and structure of seven hypervariable regions containing serotype-specific residues," *J. Virol.*, 70(3): 1836-1844 (1996).
Curiel et al., "High-efficiency gene transfer mediated by adenovirus coupled to DNA-polylysine complexes," *Hum. Gene Ther.*, 3(2): 147-154 (1992).
Devaux et al., "Structure of adenovirus fibre. I. Analysis of crystals of fibre from adenovirus serotypes 2 and 5 by electron microscopy and X-ray crystallography," *J. Molec. Biol.*, 215(4): 567-588 (1990).
Dey et al., "Molecular epidemiology of adenovirus infection among infants and children with acute gastroenteritis in Dhaka City, Bangladesh," *Infect. Genet. Evol.*, 9(4) 518-522 (2009).
Field et al., "Properties of the adenovirus DNA polymerase," *J. Biol. Chem.*, 259(15): 9487-9495 (1984).
Gall et al., "Construction and characterization of hexon-chimeric adenoviruses: specification of adenovirus serotype," *J. Virol.*, 72(12): 10260-10264 (1998).
GENBANK Accession No. ABU95388.1, "hexon, partial [Human adenovirus 9]," (Jun. 2009).
GENBANK Accession No. EDA88859.1, "hypothetical protein GOS_1918841, partial [marine metagenome]," (Apr. 2007).
GENBANK Accession No. FJ025900.1, "Simian adenovirus 43, complete genome," (Mar. 2012).
GENBANK Accession No. FJ025901.1, "Simian adenovirus 45, complete genome," (Mar. 2012).
GENBANK Accession No. JN163990.1, "Gorilla gorilla beringei adenovirus 6 hexon gene, partial cds," (Dec. 2011).
GENBANK Accession No. KC702815.1, "Gorilla beringei graueri adenovirus 9 isolate GC46 hexon gene, complete cds," (Sep. 2013).
Ghosh-Choudhury et al., "Protein IX, a minor component of the human adenovirus capsid, is essential for the packaging of full length genomes," *EMBO J.*, 6(6): 1733-1739 (1987).
Ginsberg et al., "A proposed terminology for the adenovirus antigens and virion morphological subunits," *Virology*, 28(4): 782-783 (1966).
Goins et al., "Herpes simplex virus vector-mediated gene delivery for the treatment of lower urinary tract pain," *Gene Ther.*, 16(4): 558-569 (2009).
Graham et al., "Characteristics of a human cell line transformed by DNA from human adenovirus type 5," *J. Gen. Virol.*, 36(1): 59-72 (1977).
Green et al., "Evidence for a repeating cross-beta sheet structure in the adenovirus fibre," *EMBO J.*, 2(8): 1357-1365 (1983).
Hacein-Bey-Abina et al., "A serious adverse event after successful gene therapy for X-linked severe combined immunodeficiency," *N. Engl. J. Med.*, 348(3): 255-256 (2003).
Henry et al., "Characterization of the knob domain of the adenovirus type 5 fiber protein expressed in *Escherichia coli*," *J. Virol.*, 68(8): 5239-5246 (1994).
Horvath et al., "Nonpermissivity of human peripheral blood lymphocytes to adenovirus type 2 infection," *J. Virology*, 62(1): 341-345 (1988).
Jornvall et al., "The adenovirus hexon protein. The primary structure of the polypeptide and its correlation with the hexon gene," *J. Biol. Chem.*, 256(12): 6181-6186 (1981).
Kannan et al., "Structural and functional diversity of the microbial kinome," *PLoS Biol.*, 5(3) E17 (2007).
Kay et al., "Viral vectors for gene therapy: the art of turning infectious agents into vehicles of therapeutics," *Nature Medicine*, 7(1): 33-40 (2001).
Kochanek et al., "High-capacity adenoviral vectors for gene transfer and somatic gene therapy," *Hum. Gene Ther.*, 10(15): 2451-2459 (1999).
Lasaro et al., "New insights on adenovirus as vaccine vectors," *Molecular Therapy*, 17(8): 1333-1339 (2009).
Lutz et al., "The product of the adenovirus intermediate gene IX is a transcriptional activator," *J. Virol.*, 71(7): 5102-5109 (1997).
Mayrhofer et al., "Nonreplicating vaccinia virus vectors expressing the H5 influenza virus hemagglutinin produced in modified Vero cells induce robust protection," *J. Virol.*, 83(10): 5192-5203 (2009).
Mease et al., "Safety, tolerability, and clinical outcomes after intraarticular injection of a recombinant adeno-associated vector containing a tumor necrosis factor antagonist gene: results of a phase 1/2 Study," *Journal of Rheumatology*, 37(4): 692-703 (2010).
Morsy et al., An adenoviral vector deleted for all viral coding sequences results in enhanced safety and extended expression of a leptin transgene, *Proc. Natl. Acad. Sci. USA*, 95: 7866-7871 (1998).
NCBI reference sequence AP_000218, "E3 12.5K [Human adenovirus 5]," (Dec. 2008).
NCBI reference sequence AP_000224.1, "*Homo sapiens* genomic DNA, chromosome 21q21.2, LL56-APP region, clone:B2017A3, complete sequence," (Nov. 1991).
Neumann et al., "Determination of the nucleotide sequence for the penton-base gene of human adenovirus type 5," *Gene*, 69(1) 153-157 (1988).
Novelli et al., "Deletion analysis of functional domains in baculovirus-expressed adenovirus type 2 fiber," *Virology*, 185(1): 365-376 (1991).
Roberts et al., "Three-dimensional structure of the adenovirus major coat protein hexon," *Science*, 232(4754): 1148-1151 (1986).
Roy et al., "Isolation and Characterization of Adenoviruses Persistently Shed from the Gastrointestinal Tract of Non-Human Primates," *PLOS Pathogens*, 5(7): E1000503, 1-9, (2009).
Rusch et al., "The Sorcerer II Global Ocean Sampling expedition: northwest Atlantic through eastern tropical Pacific," *PLoS Biol.*, 5(3) E77 (2007).
Rux et al., "Structural and phylogenetic analysis of adenovirus hexons by use of high-resolution x-ray crystallographic, molecular modeling, and sequence-based methods," *J. Virol.*, 77(17): 9553-9566 (2003).
Signas et al., Adenovirus 3 Fiber Polypeptide Gene: Implications for the Structure of the Fiber Protein, *J. Virol.*, 53(2): 672-678 (1985).
Silver et al., "Interaction of human adenovirus serotype 2 with human lymphoid cells," *Virology*, 165(2): 377-387 (1988).
Soding, "Protein homology detection by HMM-HMM comparison," *Bioinformatics*, 21(7): 951-960 (2005).
Stewart et al., "Image reconstruction reveals the complex molecular organization of adenovirus," *Cell*, 67(1): 145-154 (1991).
Stewart et al., "Difference imaging of adenovirus: bridging the resolution gap between X-ray crystallography and electron microscopy," *EMBO J.*, 12(7): 2589-99 (1993).
Thomas et al., "Progress and problems with the use of viral vectors for gene therapy," *Nature Review Genetics*, 4(5): 346-358 (2003).
Van Oostrum et al, "Molecular composition of the adenovirus type 2 virion," *J. Virol.*, 56(2): 439-448 (1985).
Wevers et al., "A novel adenovirus of Western lowland gorillas (*Gorilla gorilla gorilla*)," *J. Virology*, 7(1): 1-8 (2010).
Wevers et al., "Novel Adenoviruses in Wild Primates: a High Level of Genetic Diversity and Evidence of Zoonotic Transmissions," *J. Virology*, 85(20): 10774-10784, (2011).
Yeh et al., "Human adenovirus type 41 contains two fibers," *Virus Res.*, 33(2): 179-198 (1994).
Yooseph et al., "The Sorcerer II Global Ocean Sampling expedition: expanding the universe of protein families," *PLoS Biol.*, 5(3) E16, (2007).
European Patent Office, Office Action in European Patent Application No. 12773193.3 (Sep. 13, 2016).

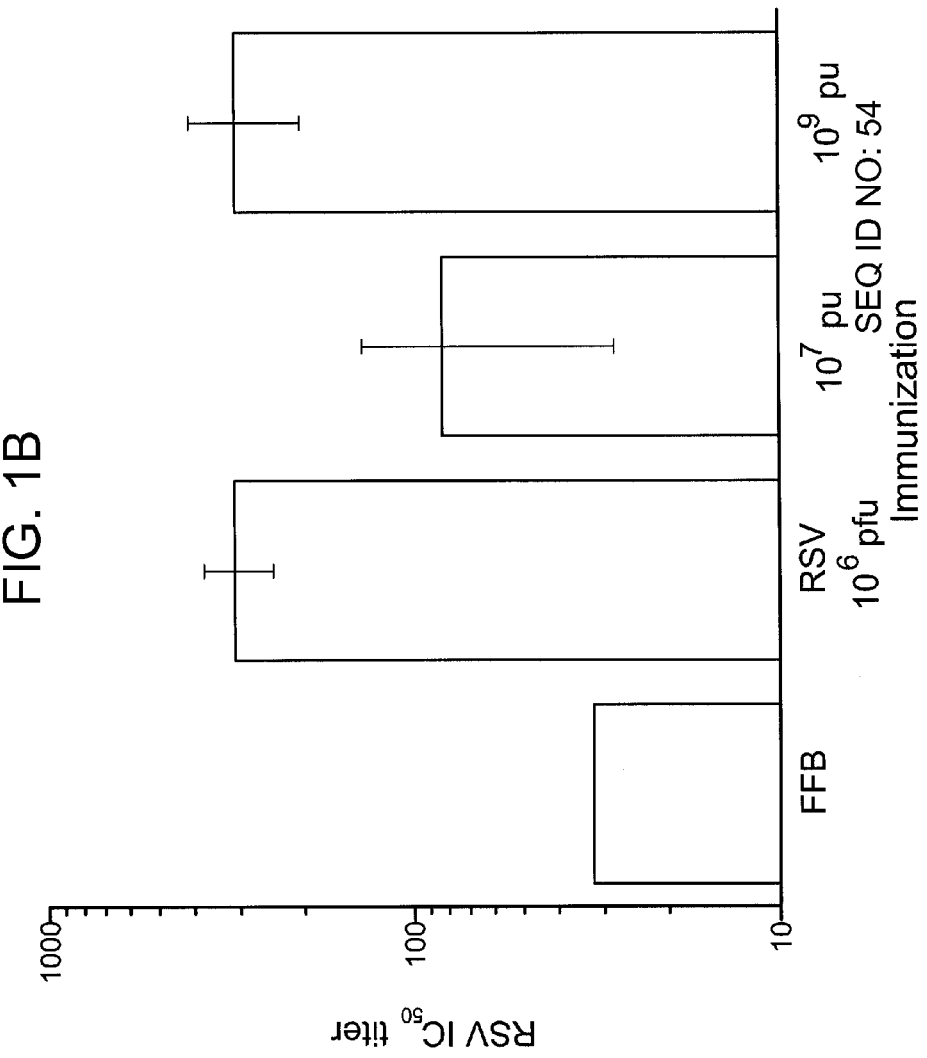

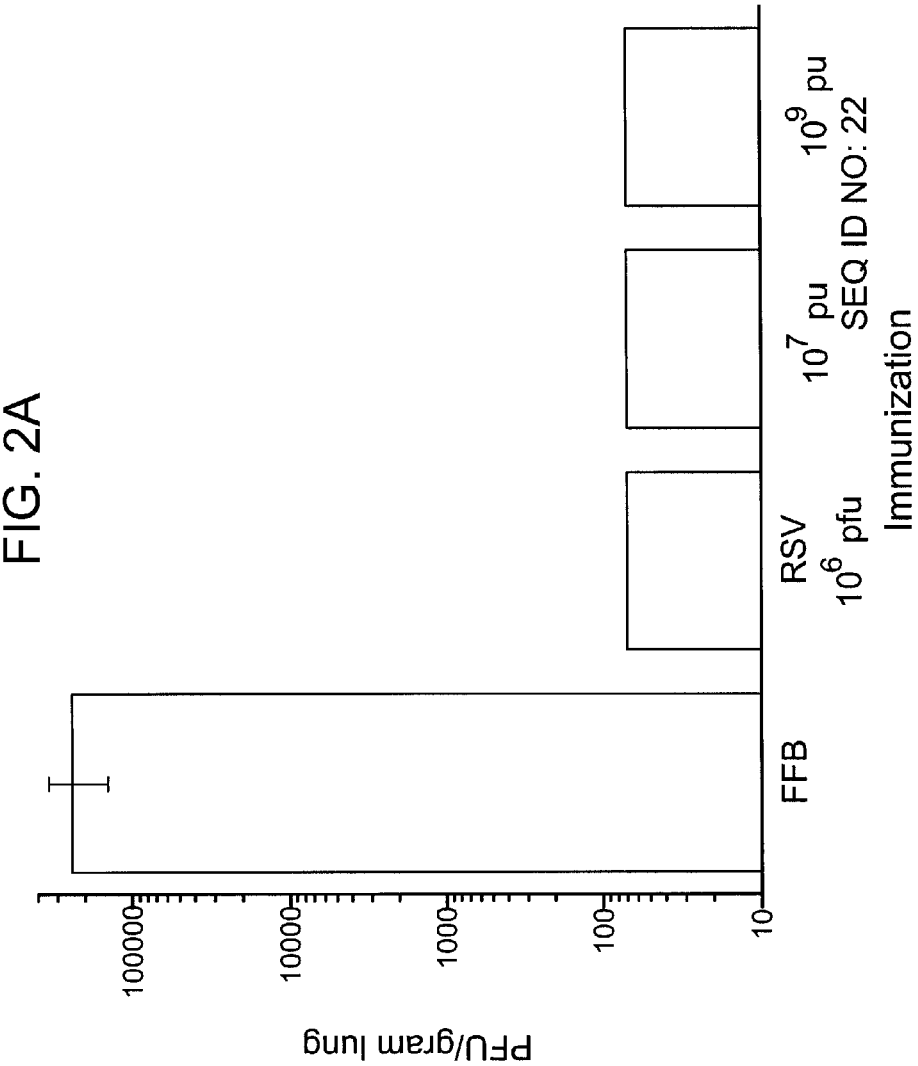

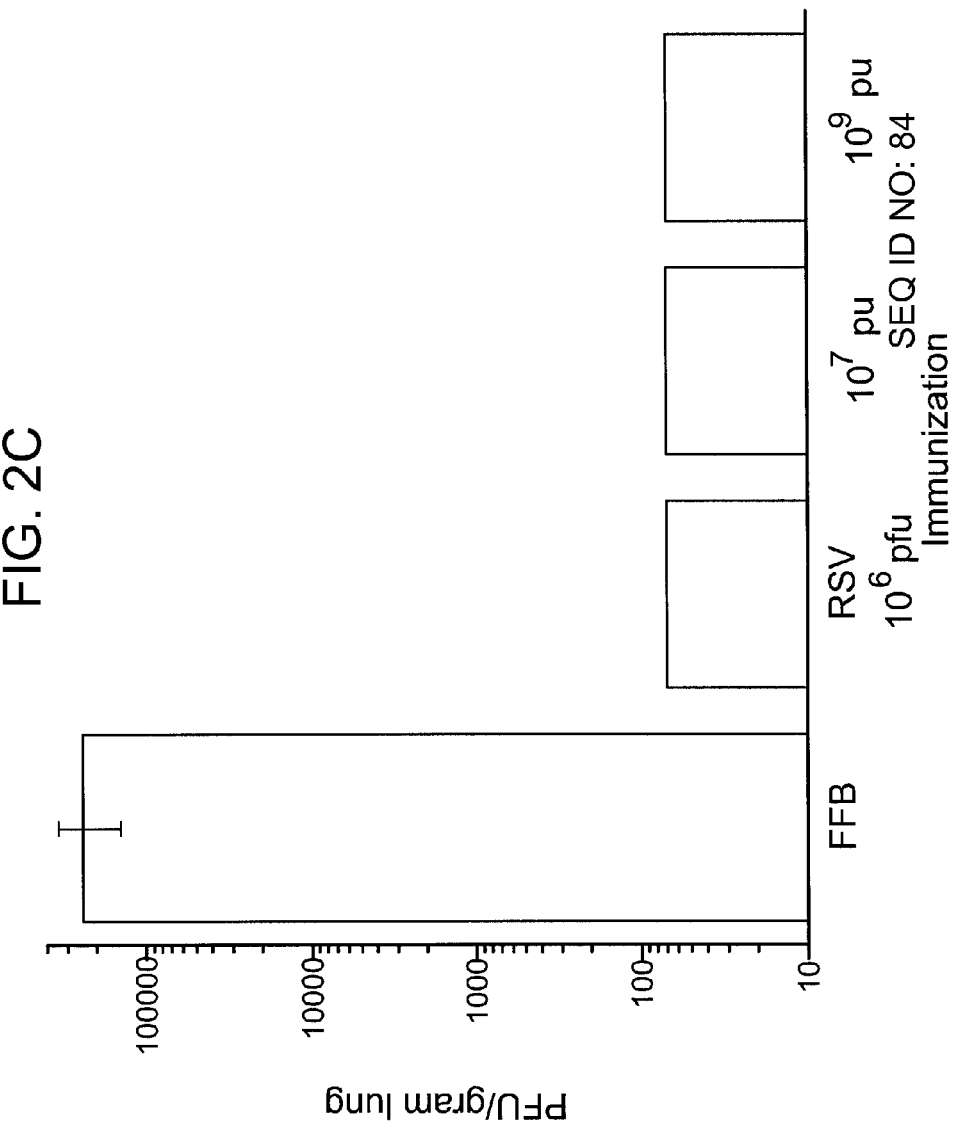

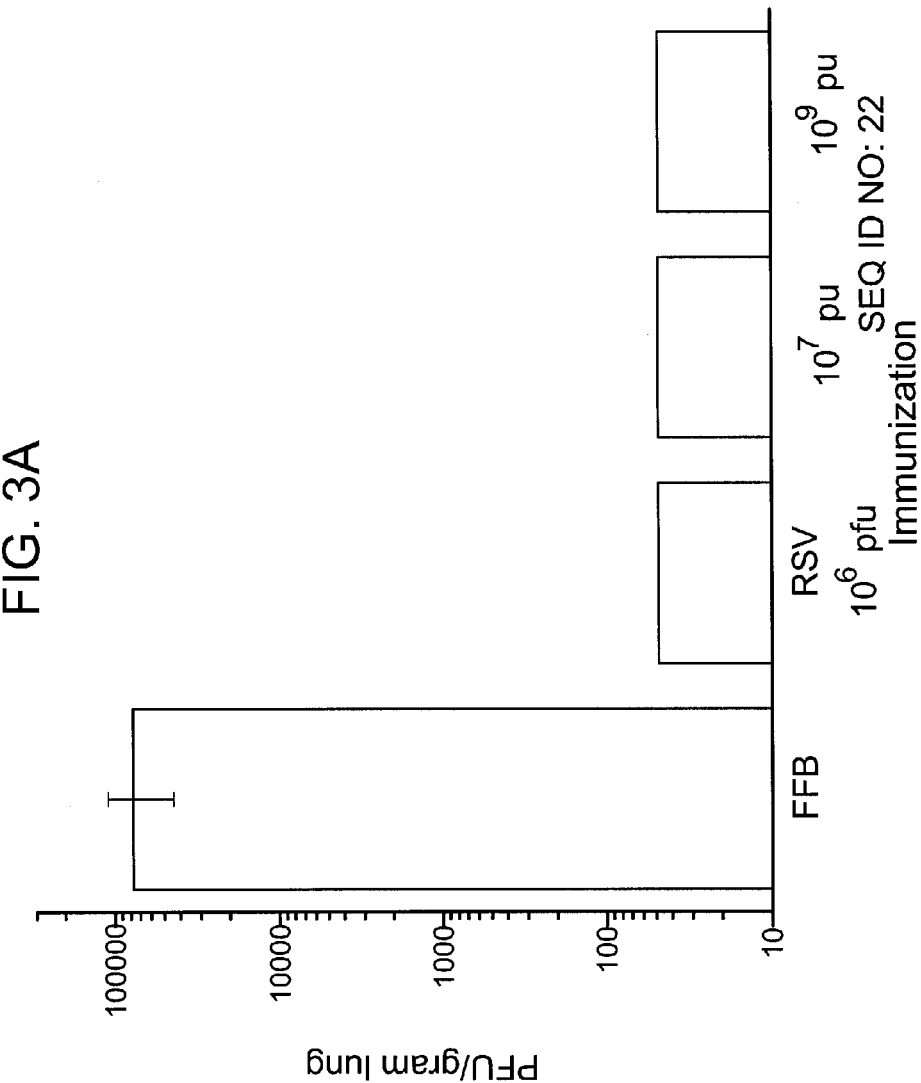

ADENOVIRAL VECTOR-BASED RESPIRATORY SYNCYTIAL VIRUS (RSV) VACCINE

CROSS-REFERENCE TO RELATED APPLICATIONS

This patent application is the U.S national phase of PCT/U2012/059043, filed Oct. 5, 2012, which claims the benefit of U.S. Provisional Patent Application No. 61/543,495; filed Oct. 5, 2011, U.S. Provisional Patent Application No. 61/543,506, filed Oct. 5, 2011, and U.S. Provisional Patent Application No. 61/543,520, filed Oct. 5, 2011, the disclosures of which are incorporated by reference.

INCORPORATION-BY-REFERENCE OF MATERIAL SUBMITTED ELECTRONICALLY

Incorporated by reference in its entirety herein is a computer-readable nucleotide/amino acid sequence listing submitted concurrently herewith and identified as follows: One 1,594,382 Byte ASCII (Text) file named "716481_ST25.txt," created on Apr. 3, 2014.

BACKGROUND OF THE INVENTION

Human respiratory syncytial virus (RSV) RSV is the leading viral cause of lower respiratory illness and hospitalization in young children. The vast majority of children infected with RSV suffer from a mild upper respiratory tract infection; however, a small subset experience severe RSV-induced lower respiratory infection (LRI) and bronchiolitis that often requires hospitalization and can be life-threatening (Collins et al., "Respiratory syncytial virus," In: Fields Virology, Knipe and Howley (eds.), Lippincott, Williams & Wilkins, New York (1996), pp. 1313-1351). Since nearly every child eventually is infected with RSV, and significant LRI develops in 20-30% of RSV-infected children, RSV causes more than 130,000 pediatric hospitalizations annually in the United States (Shay et al., JAMA, 282(15): 1440-1446 (1999), and World Health Organization, Initiative for Vaccine Research (IVR), Respiratory Syncytial Virus (RSV) at who.int/vaccine_research/diseases/ari/en/index3.html (2007)).

Some risk factors for the development of severe RSV-induced illness have been clearly identified, including premature birth (Navas et al., J. Pediatr., 121(3): 348-54 (1992)), bronchopulmonary dysplasia (Groothuis et al., Pediatrics, 82(2): 199-203 (1988)), congenital heart disease (MacDonald et al., N. Engl. J. Med., 307(7): 397-400 (1982)), and T cell immune deficiency (McIntosh et al., J. Pediatr., 82(4): 578-90 (1973)). However, more than half of the children hospitalized with severe RSV-induced illness do not have an identified risk factor (Boyce et al., J. Pediatr., 137(6): 865-70 (2000)), which means that approximately 1-2% of otherwise healthy children without any identifiable risk factors suffer the potentially life-threatening consequences of RSV-induced illness (Collins et al., supra).

RSV-induced severe illness in children also has been correlated with the development of asthma (see, e.g., Sigurs et al., Pediatrics, 95(4): 500-505 (1995); Welliver et al., Pediatr. Pulmonol., 15(1): 19-27 (1993); Cifuentes et al., Pediatr. Pulmonol., 36(4): 316-321 (2003); Schauer et al., Eur. Respir. 1, 20(5): 1277-1283 (2002); Sigurs et al., Am. J. Respir. Crit. Care Med., 161(5): 1501-1507 (2000); and Stein et al., Lancet, 354(9178): 541-545 (1999)). The basis for this association is unknown, but may be due to underlying genetic factors, immune dysfunction, antigen-specific responses, or structural lesions caused by lung remodeling after severe RSV disease.

Although RSV infection is almost universal by age three, reinfection occurs throughout life because natural RSV infection does not provide complete immunity (Hall et al., J. Infect. Dis., 163(4): 693-698 (1991); and Muelenaer et al., J. Infect. Dis., 164(1): 15-21 (1991)). In the elderly, RSV is an important cause of morbidity and mortality. In a retrospective cohort study, RSV was responsible for an annual average of 15 hospitalizations and 17 deaths per 1,000 nursing home residents, whereas influenza accounted for an average of 28 hospitalizations and 15 deaths in the same setting (Garofalo et al., Pediatr. Allergy Immunol., 5(2): 111-117 (1994)). Thus, RSV was isolated as frequently as influenza A in this population and was associated with comparable mortality as influenza A (Ellis et al., J. Am. Geriatr. Soc., 51(6): 761-72003; and Falsey et al., J. Infect. Dis., 172(2): 389-394 (1995)).

Currently there are no FDA-approved vaccines for the prevention of RSV infection or treatment of RSV-induced disease. The only FDA-approved medication for prophylaxis of RSV infection is SYNAGIS™ palivizumab (MedImmune, Gaithersburg, Md.), which is a humanized monoclonal antibody directed to an epitope in the A antigenic site of the RSV F protein administered to high-risk infants. Although SYNAGIS™ palivizumab represents a significant advance in the prevention of lower respiratory tract acute RSV disease and mitigation of lower respiratory tract infection, it has not been shown to be effective against RSV infection in the upper respiratory tract at permissible doses.

RSV vaccine development has suffered from a legacy of vaccine-enhanced disease in children after natural RSV infection (Kim et al., Am. J. Epidemiol., 89(4): 422-434 (1969); and Kapikian et al., Am. J. Epidemiol., 89(4): 405-421 (1969)). For example, a formalin-inactivated alum-precipitated vaccine candidate (FI-RSV) was administered to RSV-naïve infants in the early 1960s, and although immunogenic, it did not protect the children against natural infection. In addition, vaccinees subsequently infected with RSV had increased hospitalization rates and more severe illness, including two deaths, relative to control children immunized with formalin-inactivated parainfluenza virus (Kapikian et al., supra; Chin et al., Am. J. Epidemiol., 89(4): 449-463 (1969); and Polack et al., J. Exp. Med., 196(6): 859-65 (2002)). Other approaches to RSV immunization have included live attenuated RSV, RSV subunit proteins, and parainfluenza virus chimeras. Live attenuated RSV vaccines have been tested in clinical trials of RSV-naïve infants, but have not been shown to achieve genetic stability of mutations or an optimal balance between attenuation for safety in infants and a protective immune response (Karron et al., J. Infect. Dis., 191(7): 1093-1104 (2005); and Bukreyev et al., J. Virol., 79(15): 9515-9526 (2005)). A live attenuated parainfluenza-RSV chimera vaccine containing the attachment (G) proteins of RSV types A and B has been administered intranasally and is expected to replicate safely in children (Tang et al., J. Virol., 78(20): 11198-11207 (2004); and Schmidt et al., J. Virol., 76(3): 1089-1099 (2002)). However, data from clinical testing is not yet available. Protein subunit vaccines based on RSV G and F proteins have been safely administered to adults and RSV-seropositive children, but are modestly immunogenic (Tristram et al., Vaccine, 12(6): 551-556 (1994)). In this respect, purified subunit vaccines have not induced CD8+ T-cells and have been associated with IL-4 production, thereby raising safety concerns for use in seronegative infants. Adjuvanting subunit protein vaccines with aluminum hydroxide, MPL, or a combination of MPL and QS21 did not prevent the IL-4 response (Murphy et al., *Vaccine,* 8(5): 497-502 (1990); and Hancock et al., *J. Virol.,* 70(11): 7783-7791 (1996)). Subunit vaccines also have been shown to induce IgE isotype antibody (Welliver et al., *J. Clin. Microbiol.,* 27(2): 295-299 (1989)).

Thus, there remains a need for constructs that can be used in methods to effectively prevent and/or treat RSV infection. The invention provides such constructs and methods.

BRIEF SUMMARY OF THE INVENTION

The invention provides an adenovirus or adenoviral vector. The adenovirus or adenoviral vector comprises (1) a nucleic acid sequence encoding one or more Respiratory Syncytial Virus (RSV) antigens and (2) one or more of the nucleic acid sequences selected from the group consisting of (a) the nucleic acid sequence of SEQ ID NO: 1, (b) a nucleic acid sequence that is at least 98.5% identical to SEQ ID NO: 2, (c) a nucleic acid sequence that is at least 90% identical to SEQ ID NO: 3, (d) a nucleic acid sequence that is at least 80% identical to SEQ ID NO: 4, and (e) a nucleic acid sequence that is at least 89% identical to SEQ ID NO: 5.

The invention provides an adenovirus or adenoviral vector comprising (1) a nucleic acid sequence encoding one or more RSV antigens and (2) one or more of the nucleic acid sequences selected from the group consisting of (a) a nucleic acid sequence that is at least 98.6% identical to SEQ ID NO: 6, (b) a nucleic acid sequence that is at least 99.06% identical to SEQ ID NO: 7, (c) a nucleic acid sequence that is at least 97.13% identical to SEQ ID NO: 8, (d) a nucleic acid sequence that is at least 90.7% identical to SEQ ID NO: 9, and (e) a nucleic acid sequence that is at least 96.6% identical to SEQ ID NO: 10.

The invention provides an adenovirus or adenoviral vector comprising (1) a nucleic acid sequence encoding one or more RSV antigens and (2) one or more of the nucleic acid sequences selected from the group consisting of (a) a nucleic acid sequence comprising at least 121 contiguous nucleotides of SEQ ID NO: 6, (b) a nucleic acid sequence comprising at least 462 contiguous nucleotides of SEQ ID NO: 7, (c) a nucleic acid sequence comprising at least 234 contiguous nucleotides of SEQ ID NO: 8, (d) a nucleic acid sequence comprising at least 606 contiguous nucleotides of SEQ ID NO: 9, and (e) a nucleic acid sequence comprising at least 188 contiguous nucleotides of SEQ ID NO: 10.

The invention provides an adenovirus or adenoviral vector comprising (1) a nucleic acid sequence encoding one or more RSV antigens and (2) one or more of the amino acid sequences selected from the group consisting of (a) the amino acid sequence of SEQ ID NO: 11, (b) an amino acid sequence that is at least 82% identical to SEQ ID NO: 13, (c) an amino acid sequence that is at least 80% identical to SEQ ID NO: 14, and (d) an amino acid sequence that is at least 83% identical to SEQ ID NO: 15.

The invention provides an adenovirus or adenoviral vector comprising (1) a nucleic acid sequence encoding one or more RSV antigens and (2) one or more of the nucleic acid sequences selected from the group consisting of (a) a nucleic acid sequence encoding the amino acid sequence of SEQ ID NO: 11, (b) a nucleic acid sequence encoding an amino acid sequence that is at least 99% identical to SEQ ID NO: 12, (c) a nucleic acid sequence encoding an amino acid sequence that is at least 82% identical to SEQ ID NO: 13, (d) a nucleic acid sequence encoding an amino acid sequence that is at least 80% identical to SEQ ID NO: 14, and (e) a nucleic acid sequence encoding an amino acid sequence that is at least 83% identical to SEQ ID NO: 15.

The invention provides an adenovirus or adenoviral vector comprising (1) a nucleic acid sequence encoding one or more RSV antigens and (2) one or more of the amino acid sequences selected from the group consisting of (a) the amino acid sequence of SEQ ID NO: 16, (b) an amino acid sequence that is at least 97.8% identical to SEQ ID NO: 18, (c) an amino acid that is at least 93.4% identical to SEQ ID NO: 19, and (d) an amino acid sequence that is at least 98.2% identical to SEQ ID NO: 20.

The invention provides an adenovirus or adenoviral vector comprising (1) a nucleic acid sequence encoding one or more RSV antigens and (2) one or more of the nucleic acid sequences selected from the group consisting of (a) a nucleic acid sequence encoding the amino acid sequence of SEQ ID NO: 16, (b) a nucleic acid sequence encoding an amino acid sequence that is at least 99.78% identical to SEQ ID NO: 17, (c) a nucleic acid sequence encoding an amino acid sequence that is at least 97.8% identical to SEQ ID NO: 18, (d) a nucleic acid sequence encoding an amino acid that is at least 93.4% identical to SEQ ID NO: 19, and (e) a nucleic acid sequence encoding an amino acid sequence that is at least 98.2% identical to SEQ ID NO: 20.

The invention provides an adenovirus or adenoviral vector comprising (1) a nucleic acid sequence encoding one or more RSV antigens and (2) one or more of the amino acid sequences selected from the group consisting of (a) an amino acid sequence comprising at least 89 contiguous amino acid residues of SEQ ID NO: 16, (b) an amino acid sequence comprising at least 247 contiguous amino acid residues of SEQ ID NO: 18, (c) an amino acid sequence comprising at least 370 contiguous amino acid residues of SEQ ID NO: 19, and (d) an amino acid sequence comprising at least 192 contiguous amino acid residues of SEQ ID NO: 20.

The invention provides an adenovirus or adenoviral vector comprising (1) a nucleic acid sequence encoding one or more RSV antigens and (2) one or more of the nucleic acid sequences selected from the group consisting of (a) a nucleic acid sequence encoding an amino acid sequence comprising at least 89 contiguous amino acid residues of SEQ ID NO: 16, (b) a nucleic acid sequence encoding an amino acid sequence comprising at least 428 contiguous amino acid residues of SEQ ID NO: 17, (c) a nucleic acid sequence encoding an amino acid sequence comprising at least 247 contiguous amino acid residues of SEQ ID NO: 18, (d) a nucleic acid sequence encoding an amino acid sequence comprising at least 370 contiguous amino acid residues of SEQ ID NO: 19, and (e) a nucleic acid sequence encoding an amino acid sequence comprising at least 192 contiguous amino acid residues of SEQ ID NO: 20.

The invention provides an adenovirus or adenoviral vector comprising (1) a nucleic acid sequence encoding one or more RSV antigens and (2) one or more of the nucleic acid sequences selected from the group consisting of (a) a nucleic acid sequence that is at least 96% identical to SEQ ID NO: 27, (b) a nucleic acid sequence that is at least 99% identical to SEQ ID NO: 28, (c) a nucleic acid sequence that is at least 80% identical to SEQ ID NO: 29, (d) a nucleic acid sequence that is at least 80% identical to SEQ ID NO: 30, and (e) a nucleic acid sequence that is at least 85.4% identical to SEQ ID NO: 31.

The invention provides an adenovirus or adenoviral vector comprising (1) a nucleic acid sequence encoding one or more RSV antigens and (2) one or more of the nucleic acid sequences selected from the group consisting of (a) a nucleic acid sequence that is at least 98.7% identical to SEQ ID NO: 32. (b) a nucleic acid sequence that is at least 98.9% identical to SEQ ID NO: 33, (c) a nucleic acid sequence that is at least 99.4% identical to SEQ ID NO: 34, (d) a nucleic acid sequence that is at least 99.1% identical to SEQ ID NO: 35, (e) a nucleic acid sequence that is at least 81.25% identical to SEQ ID NO: 36, (f) a nucleic acid sequence that is at least 90.83% identical to SEQ ID NO: 37, and (g) a nucleic acid sequence that is at least 82.5% identical to SEQ ID NO: 38.

The invention provides an adenovirus or adenoviral vector comprising (1) a nucleic acid sequence encoding one or more RSV antigens and (2) one or more of the nucleic acid sequences selected from the group consisting of (a) a nucleic acid sequence comprising at least 162 contiguous nucleotides of SEQ ID NO: 32, (b) a nucleic acid sequence comprising at least 162 contiguous nucleotides of SEQ ID NO: 33, (c) a nucleic acid sequence comprising at least 121 contiguous nucleotides of SEQ ID NO: 34, (d) a nucleic acid sequence comprising at least 531 contiguous nucleotides of SEQ ID NO: 35, (e) a nucleic acid sequence comprising at least 156 contiguous nucleotides of SEQ ID NO: 36, (f) a nucleic acid sequence comprising at least 192 contiguous nucleotides of SEQ ID NO: 37, and (g) a nucleic acid sequence comprising at least 84 contiguous nucleotides of SEQ ID NO: 38.

The invention provides an adenovirus or adenoviral vector comprising (1) a nucleic acid sequence encoding one or more RSV antigens and (2) one or more of the amino acid sequences selected from the group consisting of (a) an amino acid sequence that is at least 85% identical to SEQ ID NO: 40, (b) an amino acid sequence that is at least 80% identical to SEQ ID NO: 41, and (c) an amino acid sequence that is at least 80% identical to SEQ ID NO: 42.

The invention provides an adenovirus or adenoviral vector comprising (1) a nucleic acid sequence encoding one or more RSV antigens and (2) one or more of the nucleic acid sequences selected from the group consisting of (a) a nucleic acid sequence encoding an amino acid sequence that is at least 99.7% identical to SEQ ID NO: 39, (b) a nucleic acid sequence encoding an amino acid sequence that is at least 85% identical to SEQ ID NO: 40, (c) a nucleic acid sequence encoding an amino acid sequence that is at least 80% identical to SEQ ID NO: 41, and (d) a nucleic acid sequence encoding an amino acid sequence that is at least 80% identical to SEQ ID NO: 42.

The invention provides an adenovirus or adenoviral vector comprising (1) a nucleic acid sequence encoding one or more RSV antigens and (2) one or more of the amino acid sequences selected from the group consisting of (a) an amino acid sequence that is at least 99% identical to SEQ ID NO: 44, (b) an amino acid sequence that is at least 81.4% identical to SEQ ID NO: 46, (c) an amino acid sequence that is at least 91.3% identical to SEQ ID NO: 47, and (d) an amino acid sequence that is at least 83.4% identical to SEQ ID NO: 48.

The invention provides an adenovirus or adenoviral vector comprising (1) a nucleic acid sequence encoding one or more RSV antigens and (2) one or more of the nucleic acid sequences selected from the group consisting of (a) a nucleic acid sequence encoding an amino acid sequence that is at least 99% identical to SEQ ID NO: 44, (b) a nucleic acid sequence encoding an amino acid sequence that is at least 99.75% identical to SEQ ID NO: 45, (c) a nucleic acid sequence encoding an amino acid sequence that is at least 81.4% identical to SEQ ID NO: 46, (d) a nucleic acid sequence encoding an amino acid sequence that is at least 91.3% identical to SEQ ID NO: 47, (e) a nucleic acid sequence encoding an amino acid sequence that is at least 83.4% identical to SEQ ID NO: 48.

The invention provides an adenovirus or adenoviral vector comprising (1) a nucleic acid sequence encoding one or more RSV antigens and (2) one or more of the amino acid sequences selected from the group consisting of (a) an amino acid sequence comprising at least 89 contiguous amino acid residues of SEQ ID NO: 44, (b) an amino acid sequence comprising at least 114 contiguous amino acid residues of SEQ ID NO: 46, (c) an amino acid sequence comprising at least 231 contiguous amino acid residues of SEQ ID NO: 47, and (d) an amino acid sequence comprising at least 30 contiguous amino acid residues of SEQ ID NO: 48.

The invention provides an adenovirus or adenoviral vector comprising (1) a nucleic acid sequence encoding one or more RSV antigens and (2) one or more of the nucleic acid sequences selected from the group consisting of (a) a nucleic acid sequence encoding an amino acid sequence comprising at least 89 contiguous amino acid residues of SEQ ID NO: 44, (b) a nucleic acid sequence encoding an amino acid sequence comprising at least 428 contiguous amino acid residues of SEQ ID NO: 45, (c) a nucleic acid sequence encoding an amino acid sequence comprising at least 114 contiguous amino acid residues of SEQ ID NO: 46, (d) a nucleic acid sequence encoding an amino acid sequence comprising at least 231 contiguous amino acid residues of SEQ ID NO: 47, and (e) a nucleic acid sequence encoding an amino acid sequence comprising at least 30 contiguous amino acid residues of SEQ ID NO: 48.

The invention provides an adenovirus or adenoviral vector comprising (1) a nucleic acid sequence encoding one or more RSV antigens and (2) one or more of the nucleic acid sequences selected from the group consisting of (a) a nucleic acid sequence that is at least 97% identical to SEQ ID NO: 63, (b) a nucleic acid sequence that is at least 97.5% identical to SEQ ID NO: 64, (c) a nucleic acid sequence that is at least 80% identical to SEQ ID NO: 65, (d) a nucleic acid sequence that is at least 96% identical to SEQ ID NO: 66, and (e) a nucleic acid sequence that is at least 96% identical to SEQ ID NO: 67.

The invention provides an adenovirus or adenoviral vector comprising (1) a nucleic acid sequence encoding one or more RSV antigens and (2) one or more of the nucleic acid sequences selected from the group consisting of (a) a nucleic acid sequence that is at least 98.4% identical to SEQ ID NO: 68, (b) a nucleic acid sequence that is at least 99.01% identical to SEQ ID NO: 69, (c) a nucleic acid sequence that is at least 97.08% identical to SEQ ID NO: 70, (d) a nucleic acid sequence that is at least 96.52% identical to SEQ ID NO: 71, and (e) a nucleic acid sequence that is at least 98.49% identical to SEQ ID NO: 72.

The invention provides an adenovirus or adenoviral vector comprising (1) a nucleic acid sequence encoding one or more RSV antigens and (2) one or more of the nucleic acid sequences selected from the group consisting of (a) a nucleic acid sequence comprising at least 121 contiguous nucleotides of SEQ ID NO: 68, (b) a nucleic acid sequence comprising at least 462 contiguous nucleotides of SEQ ID NO: 69, (c) a nucleic acid sequence comprising at least 234 contiguous nucleotides of SEQ ID NO: 70, (d) a nucleic acid sequence comprising at least 606 contiguous nucleotides of SEQ ID NO: 71, and (e) a nucleic acid sequence comprising at least 188 contiguous nucleotides of SEQ ID NO: 72.

The invention provides an adenovirus or adenoviral vector comprising (1) a nucleic acid sequence encoding one or more RSV antigens and (2) one or more of the amino acid sequences selected from the group consisting of (a) an amino acid sequence that is at least 93% identical to SEQ ID NO: 73, (b) an amino acid sequence that is at least 80% identical to SEQ ID NO: 75, (c) an amino acid sequence that is at least 92% identical to SEQ ID NO: 76, and (d) an amino acid sequence that is at least 88% identical to SEQ ID NO: 77.

The invention provides an adenovirus or adenoviral vector comprising (1) a nucleic acid sequence encoding one or more RSV antigens and (2) one or more of the nucleic acid sequences selected from the group consisting of (a) a nucleic acid sequence encoding an amino acid sequence that is at least 93% identical to SEQ ID NO: 73, (b) a nucleic acid sequence encoding an amino acid sequence that is at least 95% identical to SEQ ID NO: 74, (c) a nucleic acid sequence encoding an amino acid sequence that is at least 80% identical to SEQ ID NO: 75, (d) a nucleic acid sequence encoding an amino acid sequence that is at least 92% identical to SEQ ID NO: 76, and (e) a nucleic acid sequence encoding an amino acid sequence that is at least 88% identical to SEQ ID NO: 77.

The invention provides an adenovirus or adenoviral vector comprising (1) a nucleic acid sequence encoding one or more RSV antigens and (2) one or more of the amino acid sequences selected from the group consisting of (a) an amino acid sequence that is at least 99% identical to SEQ ID NO: 78, (b) an amino acid sequence that is at least 97.8% identical to SEQ ID NO: 80, (c) an amino acid sequence that is at least 99.1% identical to SEQ ID NO: 81, and (d) an amino acid sequence that is at least 99.2% identical to SEQ ID NO: 82.

The invention provides an adenovirus or adenoviral vector comprising (1) a nucleic acid sequence encoding one or more RSV antigens and (2) one or more of the nucleic acid sequences selected from the group consisting of (a) a nucleic acid sequence encoding an amino acid sequence that is at least 99% identical to SEQ ID NO: 78, (b) a nucleic acid sequence encoding an amino acid sequence that is at least 99.5% identical to SEQ ID NO: 79, (c) a nucleic acid sequence encoding an amino acid sequence that is at least 97.8% identical to SEQ ID NO: 80, (d) a nucleic acid sequence encoding an amino acid sequence that is at least 99.1% identical to SEQ ID NO: 81, and (e) a nucleic acid sequence encoding an amino acid sequence that is at least 99.2% identical to SEQ ID NO: 82.

The invention provides an adenovirus or adenoviral vector comprising (1) a nucleic acid sequence encoding one or more RSV antigens and (2) one or more of the amino acid sequences selected from the group consisting of (a) an amino acid sequence comprising at least 89 contiguous amino acid residues of SEQ ID NO: 78, (b) an amino acid sequence comprising at least 247 contiguous amino acid residues of SEQ ID NO: 80, (c) an amino acid sequence comprising at least 230 contiguous amino acid residues of SEQ ID NO: 81, and (d) an amino acid sequence comprising at least 231 contiguous amino acid residues of SEQ ID NO: 82.

The invention provides an adenovirus or adenoviral vector comprising (1) a nucleic acid sequence encoding one or more RSV antigens and (2) one or more of the nucleic acid sequences selected from the group consisting of (a) a nucleic acid sequence encoding an amino acid sequence comprising at least 89 contiguous amino acid residues of SEQ ID NO: 78, (b) a nucleic acid sequence encoding an amino acid sequence comprising at least 286 contiguous amino acid residues of SEQ ID NO: 79, (c) a nucleic acid sequence encoding an amino acid sequence comprising at least 247 contiguous amino acid residues of SEQ ID NO: 80, (d) a nucleic acid sequence encoding an amino acid sequence comprising at least 230 contiguous amino acid residues of SEQ ID NO: 81, and (e) a nucleic acid sequence encoding an amino acid sequence comprising at least 231 contiguous amino acid residues of SEQ ID NO: 82.

The invention provides a method of inducing an immune response against RSV in a mammal, especially a human, which comprises administering to the mammal an aforementioned inventive adenovirus or adenoviral vector, whereupon the nucleic acid sequence encoding the RSV antigen is expressed in the mammal to produce the RSV antigen and thereby induce an immune response against RSV in the mammal.

BRIEF DESCRIPTION OF THE SEVERAL VIEWS OF THE DRAWING(S)

Figure 1C:
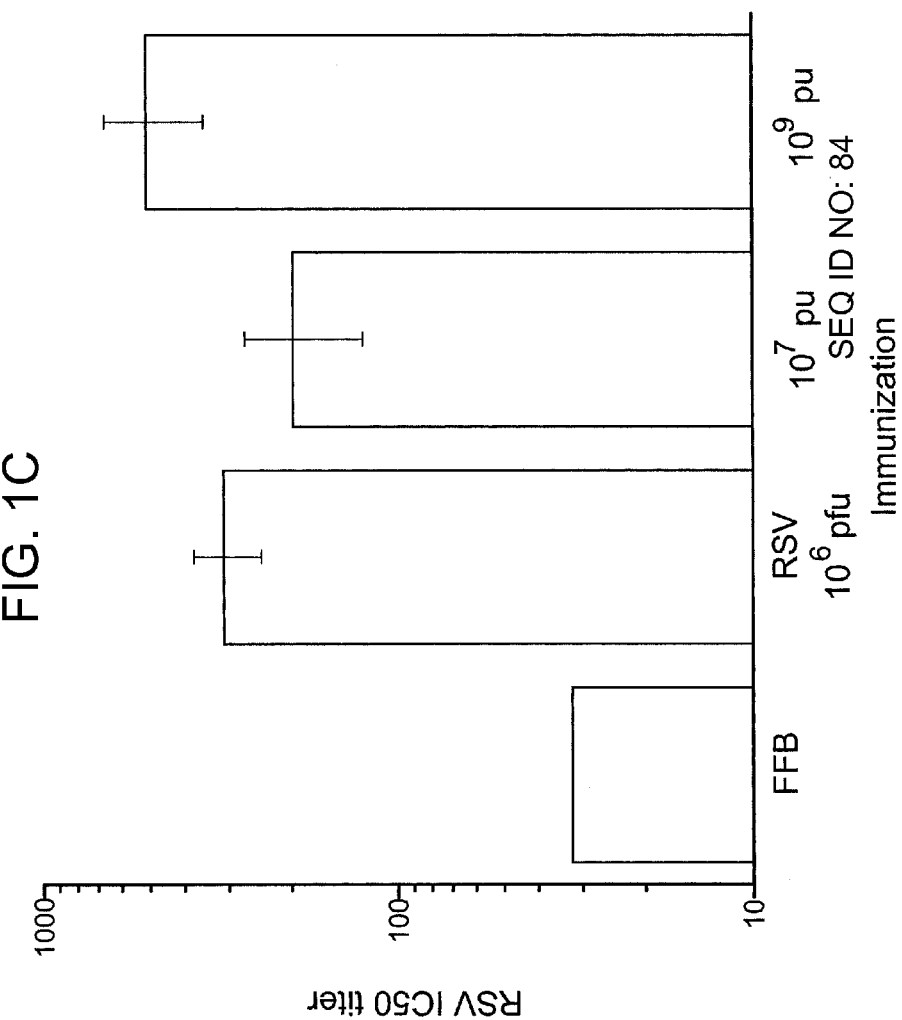

FIGS. 1A-1C are graphs which depict experimental data illustrating that immunization of cotton rats with an adenoviral vector having SEQ ID NO: 22 (FIG. 1A), SEQ ID NO: 54 (FIG. 1B), or SEQ ID NO: 84 (FIG. 1C), each of which encodes the RSV F protein, induces RSV-specific neutralizing antibodies. The data represent mean (±standard deviation) particle forming units (PFU)/gram lung tissue with 4-6 rats per group.

Figure 2B:
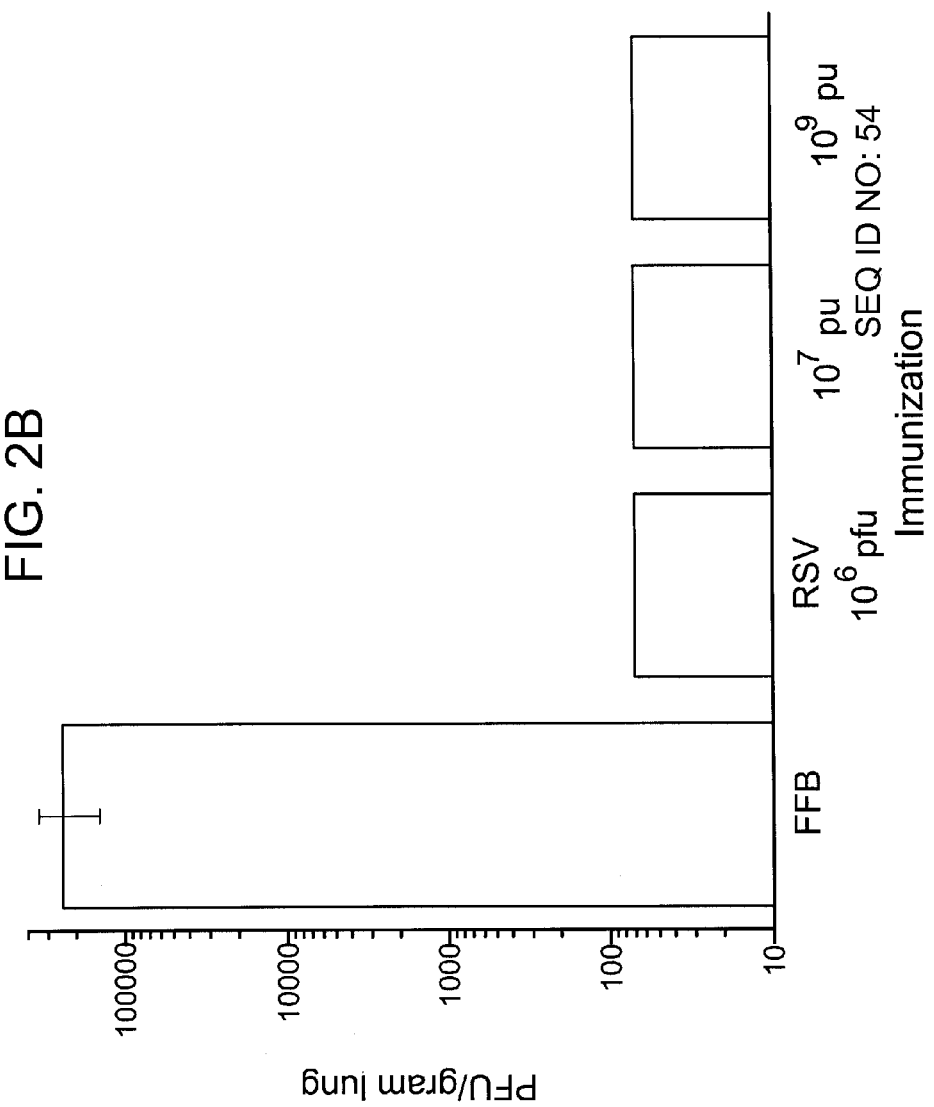

FIGS. 2A-2C are graphs which depict experimental data illustrating that immunization of cotton rats with an adenoviral vector having SEQ ID NO: 22 (FIG. 2A), SEQ ID NO: 54 (FIG. 2B), or SEQ ID NO: 84 (FIG. 2C), each of which encodes the RSV F protein, protects cotton rats against challenge with RSV. The data represent mean (±standard deviation) particle forming units (PFU)/gram lung tissue with 4-6 rats per group.

Figure 3B:
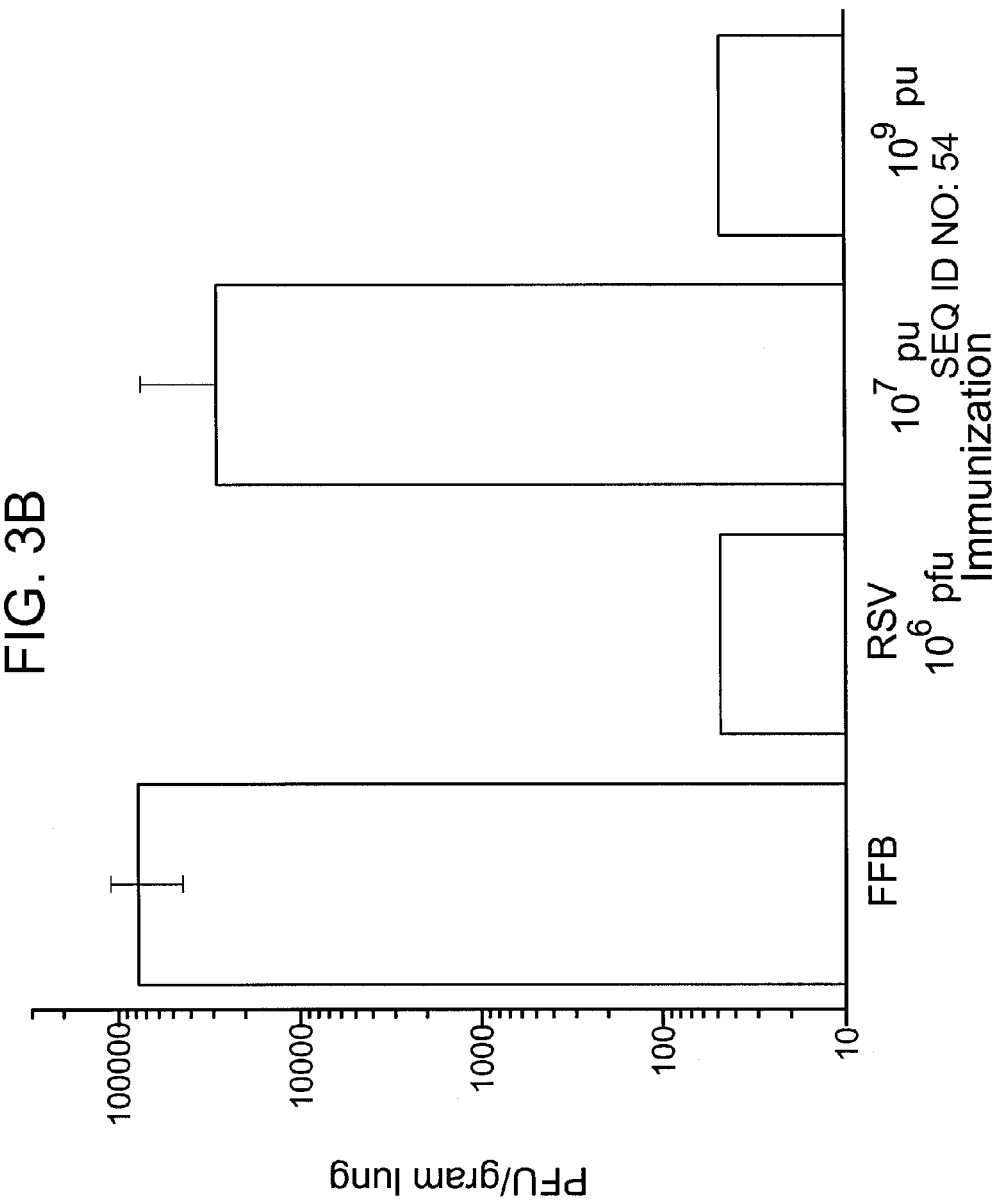
Figure 3C:
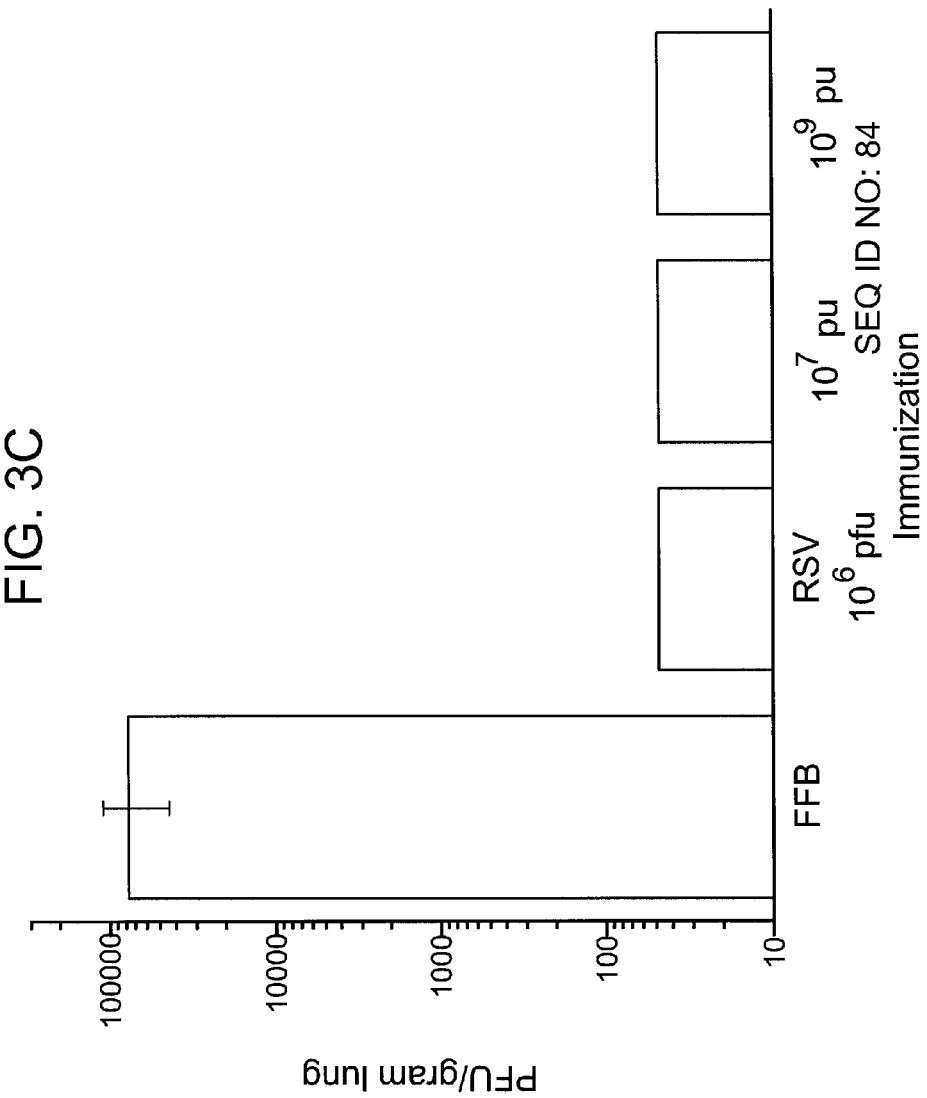

FIGS. 3A-3C are graphs which depict experimental data illustrating that immunization of BALBc mice with an adenoviral vector having SEQ ID NO: 22 (FIG. 3A), SEQ ID NO: 54 (FIG. 3B), or SEQ ID NO: 84 (FIG. 3C), each of which encodes the RSV F protein, protects mice against challenge with RSV. The data represent mean (±standard deviation) particle forming units (PFU)/gram lung tissue with five mice per group.

DETAILED DESCRIPTION OF THE INVENTION

Adenoviruses are generally associated with benign pathologies in humans, and the genomes of adenoviruses isolated from a variety of species, including humans, have been extensively studied. Adenovirus is a medium-sized (90-100 nm), nonenveloped icosohedral virus containing approximately 36 kb of double-stranded DNA. The adenovirus capsid mediates the key interactions of the early stages of the infection of a cell by the virus, and is required for packaging adenovirus genomes at the end of the adenovirus life cycle. The capsid comprises 252 capsomeres, which includes 240 hexons, 12 penton base proteins, and 12 fibers (Ginsberg et al., *Virology*, 28: 782-83 (1966)). The hexon comprises three identical proteins, namely polypeptide II (Roberts et al., *Science*, 232: 1148-51 (1986)). The penton base comprises five identical proteins and the fiber comprises three identical proteins. Proteins IIIa, VI, and IX are present in the adenoviral coat and are believed to stabilize the viral capsid (Stewart et al., *Cell*, 67: 145-54 (1991), and Stewart et al., *EMBO J.,* 12(7): 2589-99 (1993)). The expression of the capsid proteins, with the exception of pIX, is dependent on the adenovirus polymerase protein. Therefore, major components of an adenovirus particle are expressed from the genome only when the polymerase protein gene is present and expressed.

Several features of adenoviruses make them ideal vehicles for transferring genetic material to cells for therapeutic applications (i.e. "gene therapy"), or for use as antigen delivery systems for vaccine applications. For example, adenoviruses can be produced in high titers (e.g., about $10^{13}$ particle units (pu)), and can transfer genetic material to nonreplicating and replicating cells. The adenoviral genome can be manipulated to carry a large amount of exogenous DNA (up to about 8 kb), and the adenoviral capsid can potentiate the transfer of even longer sequences (Curiel et al., *Hum. Gene Ther.,* 3: 147-154 (1992)). Additionally, adenoviruses generally do not integrate into the host cell chromosome, but rather are maintained as a linear episome, thereby minimizing the likelihood that a recombinant adenovirus will interfere with normal cell function.

The invention is predicated, at least in part, on the discovery and isolation of an adenovirus that has not previously been identified or isolated. The adenovirus described herein was isolated from a gorilla. There are four widely recognized gorilla subspecies *within* the two species of Eastern Gorilla (*Gorilla beringei*) and Western Gorilla (*Gorilla gorilla*). The Western Gorilla species includes the subspecies Western Lowland Gorilla (*Gorilla gorilla gorilla*) and Cross River Gorilla (*Gorilla gorilla diehli*). The Eastern Gorilla species includes the subspecies Mountain Gorilla (*Gorilla beringei beringei*) and Eastern Lowland Gorilla (*Gorilla beringei graueri*) (see, e.g., Wilson and Reeder, eds., *Mammalian Species of the World,* $3^{rd}$ ed., Johns Hopkins University Press, Baltimore, Md. (2005)). The adenovirus of the invention was isolated from Mountain Gorilla (*Gorilla beringei beringei*).

The genomes of several such adenoviruses have been analyzed, and it has been determined that the adenovirus can have the nucleic acid sequence of, for example, SEQ ID NO: 21, SEQ ID NO: 22, SEQ ID NO: 23, SEQ ID NO: 24, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 83, SEQ ID NO: 84, SEQ ID NO: 85, SEQ ID NO: 86, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, or SEQ ID NO: 98, each of which includes a number of sub-sequences that serve to uniquely define the adenovirus, namely the nucleic acid sequences SEQ ID NOs: 1-10, 27-38, and 63-72, and amino acid sequences SEQ ID NOs: 11-20, 39-48, and 73-82. SEQ ID NOs: 6-10 encode the amino acid sequences of SEQ ID NOs: 16-20, respectively. SEQ ID NOs: 1-5 are a subset of the nucleic acid sequences of SEQ ID NOs: 6-10, respectively. SEQ ID NOs: 11-15 are a subset of the amino acid sequences of SEQ ID NOs: 16-20, respectively. SEQ ID NOs: 32-38 encode the amino acid sequences of SEQ ID NOs: 43-48, respectively. SEQ ID NOs: 27-31 are a subset of the nucleic acid sequences of SEQ ID NOs: 32 and 35-38, respectively. SEQ ID NOs: 39-42 are a subset of the amino acid sequences of SEQ ID NOs: 45-48, respectively. SEQ ID NOs: 68-72 encode the amino acid sequences of SEQ ID NOs: 78-82, respectively. SEQ ID NOs: 63-67 are a subset of the nucleic acid sequences of SEQ ID NOs: 68-72, respectively. SEQ ID NOs: 73-77 are a subset of the amino acid sequences of SEQ ID NOs: 78-82, respectively.

The adenovirus can be modified in the same manner as previously known adenoviruses to be used as an adenoviral vector, e.g., a gene delivery vehicle.

The term "adenovirus," as used herein, refers to an adenovirus that retains the ability to participate in the adenovirus life cycle and has not been physically inactivated by, for example, disruption (e.g., sonication), denaturing (e.g., using heat or solvents), or cross-linkage (e.g., via formalin cross-linking). The "adenovirus life cycle" includes (1) virus binding and entry into cells, (2) transcription of the adenoviral genome and translation of adenovirus proteins, (3) replication of the adenoviral genome, and (4) viral particle assembly (see, e.g., *Fields Virology,* $5^{th}$ ed., Knipe et al. (eds.), Lippincott, Williams & Wilkins, Philadelphia (2006)).

The term "adenoviral vector," as used herein, refers to an adenovirus in which the adenoviral genome has been manipulated to accommodate a nucleic acid sequence that is non-native with respect to the adenoviral genome. Typically, an adenoviral vector is generated by introducing one or more mutations (e.g., a deletion, insertion, or substitution) into the adenoviral genome of the adenovirus so as to accommodate the insertion of a non-native nucleic acid sequence, for example, for gene transfer, into the adenovirus.

The adenovirus or adenoviral vector can be replication-competent, conditionally replication-competent, or replication-deficient.

A replication-competent adenovirus or adenoviral vector can replicate in typical host cells, i.e., cells typically capable of being infected by an adenovirus. A replication-competent adenovirus or adenoviral vector can have one or more mutations as compared to the wild-type adenovirus (e.g., one or more deletions, insertions, and/or substitutions) in the adenoviral genome that do not inhibit viral replication in host cells. For example, the adenovirus or adenoviral vector can have a partial or entire deletion of the adenoviral early region known as the E3 region, which is not essential for propagation of the adenovirus or adenoviral genome.

A conditionally-replicating adenovirus or adenoviral vector is an adenovirus or adenoviral vector that has been engineered to replicate under pre-determined conditions. For example, replication-essential gene functions, e.g., gene functions encoded by the adenoviral early regions, can be operably linked to an inducible, repressible, or tissue-specific transcription control sequence, e.g., promoter. In such an embodiment, replication requires the presence or absence of specific factors that interact with the transcription control sequence. Conditionally-replicating adenoviral vectors are further described in U.S. Pat. No. 5,998,205.

A replication-deficient adenovirus or adenoviral vector is an adenovirus or adenoviral vector that requires complementation of one or more gene functions or regions of the adenoviral genome that are required for replication, as a result of, for example, a deficiency in one or more replication-essential gene function or regions, such that the adenovirus or adenoviral vector does not replicate in typical host cells, especially those in a human to be infected by the adenovirus or adenoviral vector.

A deficiency in a gene function or genomic region, as used herein, is defined as a disruption (e.g., deletion) of sufficient genetic material of the adenoviral genome to obliterate or impair the function of the gene (e.g., such that the function of the gene product is reduced by at least about 2-fold, 5-fold, 10-fold, 20-fold, 30-fold, or 50-fold) whose nucleic acid sequence was disrupted (e.g., deleted) in whole or in part. Deletion of an entire gene region often is not required for disruption of a replication-essential gene function. However, for the purpose of providing sufficient space in the adenoviral genome for one or more transgenes, removal of a majority of one or more gene regions may be desirable. While deletion of genetic material is preferred, mutation of genetic material by addition or substitution also is appropriate for disrupting gene function. Replication-essential gene functions are those gene functions that are required for adenovirus replication (e.g., propagation) and are encoded by, for example, the adenoviral early regions (e.g., the E1, E2, and E4 regions), late regions (e.g., the L1, L2, L3, L4, and L5 regions), genes involved in viral packaging (e.g., the IVa2 gene), and virus-associated RNAs (e.g., VA-RNA-1 and/or VA-RNA-2).

Whether the adenovirus or adenoviral vector is replication-competent or replication-deficient, the adenovirus or adenoviral vector retains at least a portion of the adenoviral genome. The adenovirus or adenoviral vector can comprise any portion of the adenoviral genome, including protein coding and non-protein coding regions. Desirably, the adenovirus or adenoviral vector comprises at least one nucleic acid sequence that encodes an adenovirus protein. The adenovirus or adenoviral vector can comprise a nucleic acid sequence that encodes any suitable adenovirus protein, such as, for example, a protein encoded by any one of the early region genes (i.e., E1A, E1B, E2A, E2B, E3, and/or E4 regions), or a protein encoded by any one of the late region genes, which encode the virus structural proteins (i.e., L1, L2, L3, L4, and L5 regions).

The adenovirus or adenoviral vector desirably comprises one or more nucleic acid sequences that encode the pIX protein, the DNA polymerase protein, the penton protein, the hexon protein, and/or the fiber protein. The adenovirus or adenoviral vector can comprise a full-length nucleic acid sequence that encodes a full-length amino acid sequence of an adenovirus protein. Alternatively, the adenovirus or adenoviral vector can comprise a portion of a full-length nucleic acid sequence that encodes a portion of a full-length amino acid sequence of an adenovirus protein.

A "portion" of a nucleic acid sequence comprises at least ten nucleotides (e.g., about 10 to about 5000 nucleotides). Preferably, a "portion" of a nucleic acid sequence comprises 10 or more (e.g., 15 or more, 20 or more, 25 or more, 30 or more, 35 or more, 40 or more, 45 or more, 50 or more, or 100 or more) nucleotides, but less than 5,000 (e.g., 4900 or less, 4000 or less, 3000 or less, 2000 or less, 1000 or less, 800 or less, 500 or less, 300 or less, or 100 or less) nucleotides. Preferably, a portion of a nucleic acid sequence is about 10 to about 3500 nucleotides (e.g., about 10, 20, 30, 50, 100, 300, 500, 700, 1000, 1500, 2000, 2500, or 3000 nucleotides), about 10 to about 1000 nucleotides (e.g., about 25, 55, 125, 325, 525, 725, or 925 nucleotides), or about 10 to about 500 nucleotides (e.g., about 15, 30, 40, 50, 60, 70, 80, 90, 150, 175, 250, 275, 350, 375, 450, 475, 480, 490, 495, or 499 nucleotides), or a range defined by any two of the foregoing values. More preferably, a "portion" of a nucleic acid sequence comprises no more than about 3200 nucleotides (e.g., about 10 to about 3200 nucleotides, about 10 to about 3000 nucleotides, or about 30 to about 500 nucleotides, or a range defined by any two of the foregoing values).

A "portion" of an amino acid sequence comprises at least three amino acids (e.g., about 3 to about 1,200 amino acids). Preferably, a "portion" of an amino acid sequence comprises 3 or more (e.g., 5 or more, 10 or more, 15 or more, 20 or more, 25 or more, 30 or more, 40 or more, or 50 or more) amino acids, but less than 1,200 (e.g., 1,000 or less, 800 or less, 700 or less, 600 or less, 500 or less, 400 or less, 300 or less, 200 or less, or 100 or less) amino acids. Preferably, a portion of an amino acid sequence is about 3 to about 500 amino acids (e.g., about 10, 100, 200, 300, 400, or 500 amino acids), about 3 to about 300 amino acids (e.g., about 20, 50, 75, 95, 150, 175, or 200 amino acids), or about 3 to about 100 amino acids (e.g., about 15, 25, 35, 40, 45, 60, 65, 70, 80, 85, 90, 95, or 99 amino acids), or a range defined by any two of the foregoing values. More preferably, a "portion" of an amino acid sequence comprises no more than about 500 amino acids (e.g., about 3 to about 400 amino acids, about 10 to about 250 amino acids, or about 50 to about 100 amino acids, or a range defined by any two of the foregoing values).

The adenovirus pIX protein is present in the adenovirus capsid, has been shown to strengthen hexon nonamer interactions, and is essential for the packaging of full-length genomes (see, e.g., Boulanger et al., *J. Gen. Virol.,* 44: 783-800 (1979); Horwitz M. S., "Adenoviridae and their replication" in *Virology,* $2^{nd}$ ed., B. N. Fields et al. (eds.), Raven Press, Ltd., New York, pp. 1679-1721 (1990), Ghosh-Choudhury et al., *EMBO J.,* 6: 1733-1739 (1987), and van Oostrum et al, *J. Virol.,* 56: 439-448 (1985)). In addition to its contribution to adenovirus structure, pIX also has been shown to exhibit transcriptional properties, such as stimulation of adenovirus major late promoter (MLP) activity (see, e.g., Lutz et al., *J. Virol.,* 71(7): 5102-5109 (1997)). Nucleic acid sequences that encode all or a portion of an adenovirus pIX protein include, for example, SEQ ID NO: 6, SEQ ID NO: 1, SEQ ID NO: 32, SEQ ID NO: 33, SEQ ID NO: 34, SEQ ID NO: 68, and SEQ ID NO: 63. SEQ ID NO: 27 is a subset of SEQ ID NO: 32. Amino acid sequences that comprise a full-length pIX protein, or a portion thereof, include, for example, SEQ ID NO: 16, SEQ ID NO: 11, SEQ ID NO: 43, SEQ ID NO: 44, SEQ ID NO: 78, and SEQ ID NO: 73.

The adenovirus DNA polymerase protein is essential for viral DNA replication both in vitro and in vivo. The polymerase co-purifies in a complex with the precursor (pTP) of the terminal protein (TP), which is covalently attached to the 5' ends of adenovirus DNA (Field et al., *J. Biol. Chem.,* 259: 9487-9495 (1984)). Both the adenovirus DNA polymerase and pTP are encoded by the E2 region. The polymerase protein is required for the expression of all the structural proteins except for pIX. Without the gene sequence for polymerase protein, polymerase protein is not produced. As a result, the viral genome is not replicated, the Major Late Promoter is not activated, and the capsid proteins are not expressed. Nucleic acid sequences that encode all or a portion of an adenovirus DNA polymerase protein include, for example, SEQ ID NO: 7, SEQ ID NO: 2, SEQ ID NO: 35, and SEQ ID NO: 69. SEQ ID NO: 28 is a subset of SEQ ID NO: 35, and SEQ ID NO: 64 is a subset of SEQ ID NO: 69. Amino acid sequences that comprise a full-length adenovirus DNA polymerase, or a portion thereof, include, for example, SEQ ID NO: 17, SEQ ID NO: 12, SEQ ID NO: 45, SEQ ID NO: 39, SEQ ID NO: 79, and SEQ ID NO: 74.

The adenovirus hexon protein is the largest and most abundant protein in the adenovirus capsid. The hexon protein is essential for virus capsid assembly, determination of the icosahedral symmetry of the capsid (which in turn defines the limits on capsid volume and DNA packaging size), and integrity of the capsid. In addition, hexon is a primary target for modification in order to reduce neutralization of adenoviral vectors (see, e.g., Gall et al., *J. Virol.,*

72: 10260-264 (1998), and Rux et al., *J. Virol.*, 77(17): 9553-9566 (2003)). The major structural features of the hexon protein are shared by adenoviruses across serotypes, but the hexon protein differs in size and immunological properties between serotypes (Jornvall et al., *J. Biol. Chem.*, 256(12): 6181-6186 (1981)). A comparison of 15 adenovirus hexon proteins revealed that the predominant antigenic and serotype-specific regions of the hexon appear to be in loops 1 and 2 (i.e., L1 or l1, and LII or l2, respectively), within which are seven discrete hypervariable regions (HVR1 to HVR7) varying in length and sequence between adenoviral serotypes (Crawford-Miksza et al., *J. Virol.*, 70(3): 1836-1844 (1996)). Nucleic acid sequences that encode all or a portion of an adenovirus hexon protein include, for example, SEQ ID NO: 9, SEQ ID NO: 4, SEQ ID NO: 37, SEQ ID NO: 30, SEQ ID NO: 71, and SEQ ID NO: 66. Amino acid sequences that comprise a full-length adenovirus hexon protein, or a portion thereof, include, for example, SEQ ID NO: 19, SEQ ID NO: 14, SEQ ID NO: 47, SEQ ID NO: 41, SEQ ID NO: 81, and SEQ ID NO: 76.

The adenovirus fiber protein is a homotrimer of the adenoviral polypeptide IV that has three domains: the tail, shaft, and knob. (Devaux et al., *J. Molec. Biol.*, 215: 567-88 (1990), Yeh et al., *Virus Res.*, 33: 179-98 (1991)). The fiber protein mediates primary viral binding to receptors on the cell surface via the knob and the shaft domains (Henry et al., *J. Virol.*, 68(8): 5239-46 (1994)). The amino acid sequences for trimerization are located in the knob, which appears necessary for the amino terminus of the fiber (the tail) to properly associate with the penton base (Novelli et al., *Virology*, 185: 365-76 (1991)). In addition to recognizing cell receptors and binding the penton base, the fiber contributes to serotype identity. Fiber proteins from different adenoviral serotypes differ considerably (see, e.g., Green et al., *EMBO J.*, 2: 1357-65 (1983), Chroboczek et al., *Virology*, 186: 280-85 (1992), and Signas et al., *J. Virol.*, 53: 672-78 (1985)). Thus, the fiber protein has multiple functions key to the life cycle of adenovirus. Nucleic acid sequences that encode all or a portion of an adenovirus fiber protein include, for example, SEQ ID NO: 10, SEQ ID NO: 5, SEQ ID NO: 38, SEQ ID NO: 31, and SEQ ID NO: 72. SEQ ID NO: 67 is a subset of SEQ ID NO: 72. Amino acid sequences that comprise a full-length adenovirus fiber protein, or a portion thereof, include, for example, SEQ ID NO: 20, SEQ ID NO: 15, SEQ ID NO: 48, SEQ ID NO: 42, SEQ ID NO: 82, and SEQ ID NO: 77.

The adenovirus penton base protein is located at the vertices of the icosahedral capsid and comprises five identical monomers. The penton base protein provides a structure for bridging the hexon proteins on multiple facets of the icosahedral capsid, and provides the essential interface for the fiber protein to be incorporated in the capsid. Each monomer of the penton base contains an RGD tripeptide motif (Neumann et al., *Gene*, 69: 153-157 (1988)). The RGD tripeptide mediates binding to av integrins and adenoviruses that have point mutations in the RGD sequence of the penton base are restricted in their ability to infect cells (Bai et al., *J. Virol.*, 67: 5198-5205 (1993)). Thus, the penton base protein is essential for the architecture of the capsid and for maximum efficiency of virus-cell interaction. Nucleic acid sequences that encode all or a portion of an adenovirus penton base protein include, for example, SEQ ID NO: 8, SEQ ID NO: 3, SEQ ID NO: 36, SEQ ID NO: 29, SEQ ID NO: 70, and SEQ ID NO: 65. Amino acid sequences that comprise a full-length adenovirus penton base protein, or a portion thereof, include, for example, SEQ ID NO: 18, SEQ ID NO: 13, SEQ ID NO: 46, SEQ ID NO: 40, SEQ ID NO: 80, and SEQ ID NO: 75.

Nucleic acid or amino acid sequence "identity," as described herein, can be determined by comparing a nucleic acid or amino acid sequence of interest to a reference nucleic acid or amino acid sequence. The number of nucleotides or amino acid residues that have been changed and/or modified (such as, e.g., by point mutations, insertions, or deletions) in the reference sequence so as to result in the sequence of interest are counted. The total number of such changes is subtracted from the total length of the sequence of interest, and the difference is divided by the length of the sequence of interest and expressed as a percentage. A number of mathematical algorithms for obtaining the optimal alignment and calculating identity between two or more sequences are known and incorporated into a number of available software programs. Examples of such programs include CLUSTAL-W, T-Coffee, and ALIGN (for alignment of nucleic acid and amino acid sequences), BLAST programs (e.g., BLAST 2.1, BL2SEQ, and later versions thereof) and FASTA programs (e.g., FASTA3x, FASTM, and SSEARCH) (for sequence alignment and sequence similarity searches). Sequence alignment algorithms also are disclosed in, for example, Altschul et al., *J. Molecular Biol.*, 215(3): 403-410 (1990), Beigert et al., *Proc. Natl. Acad. Sci. USA*, 106(10): 3770-3775 (2009), Durbin et al., eds., *Biological Sequence Analysis: Probalistic Models of Proteins and Nucleic Acids*, Cambridge University Press, Cambridge, UK (2009), Soding, *Bioinformatics*, 21(7): 951-960 (2005), Altschul et al., *Nucleic Acids Res.*, 25(17): 3389-3402 (1997), and Gusfield, *Algorithms on Strings, Trees and Sequences*, Cambridge University Press, Cambridge UK (1997)).

In one embodiment, the adenovirus or adenoviral vector comprises one or more of the following nucleic acid sequences: (a) the nucleic acid sequence of SEQ ID NO: 1, (b) a nucleic acid sequence that is at least 98.5% identical (e.g., at least 98.73%, at least 98.96%, at least 99.18%, at least 99.41%, at least 99.64%, at least 99.87%, or 100% identical) to SEQ ID NO: 2, (c) a nucleic acid sequence that is at least 90% identical (e.g., at least 92.94%, at least 95.88%, 98.82%, or 100% identical) to SEQ ID NO: 3, (d) a nucleic acid sequence that is at least 80% identical (e.g., at least 80.83%, at least 83.06%, at least 85.28%, at least 87.50%, at least 89.72%, at least 91.94%, at least 94.17%, at least 96.39%, at least 98.61%, or 100% identical) to SEQ ID NO: 4, and (e) a nucleic acid sequence that is at least 89% identical (e.g., at least 92.33%, at least 95.67%, at least 99%, or 100% identical) to SEQ ID NO: 5.

The adenovirus or adenoviral vector can comprise one, two, three, four, or all five of the aforementioned sequences alone or in any combination. In this respect, the adenovirus or adenoviral vector can comprise any combination of any two of the aforementioned sequences, any combination of any three of the aforementioned sequences, any combination of any four of the aforementioned sequences, or all five of the aforementioned sequences. For example, the adenovirus or adenoviral vector can comprise the nucleic acid sequence of SEQ ID NO: 1. The adenovirus or adenoviral vector can comprise a nucleic acid sequence that is at least 98.5% identical to SEQ ID NO: 2 and a nucleic acid sequence that is at least 90% identical to SEQ ID NO: 3. The adenovirus or adenoviral vector can comprise the nucleic acid sequence of SEQ ID NO: 1, a nucleic acid sequence that is at least 90% identical to SEQ ID NO: 3, and a nucleic acid sequence that is at least 89% identical to SEQ ID NO: 5. The adenovirus or adenoviral vector can comprise (a) the nucleic acid sequence of SEQ ID NO: 1, (b) the nucleic acid sequence SEQ ID NO: 2, (c) the nucleic acid sequence of SEQ ID NO: 3, (d) the nucleic acid sequence of SEQ ID NO: 4, or (e) the nucleic acid sequence of SEQ ID NO: 5. The adenovirus or adenoviral vector can comprise (a) the nucleic acid sequence of SEQ ID NO: 1, (b) a nucleic acid sequence that is at least 98.5% identical to SEQ ID NO: 2, (c) a nucleic acid sequence that is at least 90% identical to SEQ ID NO: 3, (d) a nucleic acid sequence that is at least 80% identical to SEQ ID NO: 4, and (e) a nucleic acid sequence that is at least 89% identical to SEQ ID NO: 5. The adenovirus or adenoviral vector can comprise (a) the nucleic acid sequence of SEQ ID NO: 1, (b) the nucleic acid sequence SEQ ID NO: 2, (c) the nucleic acid sequence of SEQ ID NO: 3, (d) the nucleic acid sequence of SEQ ID NO: 4, and (e) the nucleic acid sequence of SEQ ID NO: 5.

In another embodiment, the adenovirus or adenoviral vector comprises one or more of the following nucleic acid sequences: (a) a nucleic acid sequence that is at least 98.6% identical (e.g., at least 98.85%, at least 99.10%, at least 99.35%, at least 99.60%, or 100% identical) to SEQ ID NO: 6, (b) a nucleic acid sequence that is at least 99.06% identical (e.g., at least 99.09%, at least 99.12%, at least 99.15%, at least 99.19%, at least 99.22%, at least 99.25%, at least 99.28%, at least 99.31%, at least 99.34%, at least 99.38%, at least 99.41%, at least 99.44%, at least 99.47%, at least 99.50%, at least 99.53%, at least 99.57%, at least 99.60%, at least 99.63%, at least 99.66%, at least 99.69%, at least 99.72%, at least 99.75%, at least 99.79%, at least 99.82%, at least 99.85%, at least 99.88%, at least 99.91%, at least 99.94%, at least 99.98%, or 100% identical) to SEQ ID NO: 7, (c) a nucleic acid sequence that is at least 97.13% identical (e.g., at least 97.18%, at least 97.23%, at least 97.28%, at least 97.33%, at least 97.38%, at least 97.43%, at least 97.48%, at least 97.5% at least 97.54%, at least 97.59%, at least 97.6%, at least 97.64%, at least 97.69%, at least 97.7%, at least 97.74%, at least 97.79%, at least 97.8%, at least 97.84%, at least 97.89%, at least 97.9%, at least 97.94%, at least 97.99%, at least 98%, at least 98.04%, at least 98.09%, at least 98.1%, at least 98.14%, at least 98.19%, at least 98.2%, at least 98.24%, at least 98.30%, at least 98.35%, at least 98.40%, at least 98.45%, at least 98.50%, at least 98.55%, at least 98.60%, at least 98.70%, at least 98.75%, at least 98.80%, at least 98.85%, at least 98.90%, at least 98.95%, at least 99.00%, at least 99.06%, at least 99.11%, at least 99.16%, at least 99.2%, at least 99.21%, at least 99.26%, at least 99.3%, at least 99.31%, at least 99.36%, at least 99.4%, at least 99.41%, at least 99.46%, at least 99.5%, at least 99.51%, at least 99.56%, at least 99.6%, at least 99.61%, at least 99.66%, at least 99.7%, at least 99.71%, at least 99.76%, at least 99.8%, at least 99.81%, at least 99.87%, at least 99.9%, at least 99.92%, at least 99.95%, at least 99.97%, or 100% identical) to SEQ ID NO: 8, (d) a nucleic acid sequence that is at least 90.7% identical (e.g., at least 90.73%, at least 90.77%, at least 90.80%, at least 90.84%, at least 90.87%, at least 90.91%, at least 90.94%, at least 90.98%, at least 91.01%, at least 91.05%, at least 91.08%, at least 91.12%, at least 91.15%, at least 91.19%, at least 91.22%, at least 91.26%, at least 91.29%, at least 91.33%, at least 91.36%, at least 91.40%, at least 91.43%, at least 91.46%, at least 91.50%, at least 91.53%, at least 91.57%, at least 91.60%, at least 91.64%, at least 91.67%, at least 91.71%, at least 91.74%, at least 91.78%, at least 91.81%, at least 91.85%, at least 91.88%, at least 91.92%, at least 91.95%, at least 91.99%, at least 92.02%, at least 92.06%, at least 92.09%, at least 92.13%, at least 92.16%, at least 92.19%, at least 92.23%, at least 92.26%, at least 92.30%, at least 92.33%, at least 92.37%, at least 92.40%, at least 92.44%, at least 92.47%, at least 92.51%, at least 92.54%, at least 92.58%, at least 92.61%, at least 92.65%, at least 92.68%, at least 92.72%, at least 92.75%, at least 92.79%, at least 92.82%, at least 92.86%, at least 92.89%, at least 92.92%, at least 92.96%, at least 92.99%, at least 93.03%, at least 93.06%, at least 93.10%, at least 93.13%, at least 93.17%, at least 93.20%, at least 93.24%, at least 93.27%, at least 93.31%, at least 93.34%, at least 93.38%, at least 93.41%, at least 93.45%, at least 93.48%, at least 93.52%, at least 93.55%, at least 93.58%, at least 93.62%, at least 93.65%, at least 93.69%, at least 93.72%, at least 93.76%, at least 93.79%, at least 93.83%, at least 93.86%, at least 93.90%, at least 93.93%, at least 93.97%, at least 94.00%, at least 94.04%, at least 94.07%, at least 94.11%, at least 94.14%, at least 94.18%, at least 94.21%, at least 94.25%, at least 94.28%, at least 94.31%, at least 94.35%, at least 94.38%, at least 94.42%, at least 94.45%, at least 94.49%, at least 94.52%, at least 94.56%, at least 94.59%, at least 94.63%, at least 94.66%, at least 94.70%, at least 94.73%, at least 94.77%, at least 94.80%, at least 94.84%, at least 94.87%, at least 94.91%, at least 94.94%, at least 94.98%, at least 95.01%, at least 95.04%, at least 95.08%, at least 95.11%, at least 95.15%, at least 95.18%, at least 95.22%, at least 95.25%, at least 95.29%, at least 95.32%, at least 95.36%, at least 95.39%, at least 95.43%, at least 95.46%, at least 95.50%, at least 95.53%, at least 95.57%, at least 95.60%, at least 95.64%, at least 95.67%, at least 95.71%, at least 95.74%, at least 95.77%, at least 95.81%, at least 95.84%, at least 95.88%, at least 95.91%, at least 95.95%, at least 95.98%, at least 96.02%, at least 96.05%, at least 96.09%, at least 96.12%, at least 96.16%, at least 96.19%, at least 96.23%, at least 96.26%, at least 96.30%, at least 96.33%, at least 96.37%, at least 96.40%, at least 96.44%, at least 96.47%, at least 96.50%, at least 96.54%, at least 96.57%, at least 96.61%, at least 96.64%, at least 96.68%, at least 96.71%, at least 96.75%, at least 96.78%, at least 96.82%, at least 96.85%, at least 96.89%, at least 96.92%, at least 96.96%, at least 96.99%, at least 97.03%, at least 97.06%, at least 97.10%, at least 97.13%, at least 97.17%, at least 97.20%, at least 97.23%, at least 97.27%, at least 97.30%, at least 97.34%, at least 97.37%, at least 97.41%, at least 97.44%, at least 97.48%, at least 97.51%, at least 97.55%, at least 97.58%, at least 97.62%, at least 97.65%, at least 97.69%, at least 97.72%, at least 97.76%, at least 97.79%, at least 97.83%, at least 97.86%, at least 97.89%, at least 97.93%, at least 97.96%, at least 98.00%, at least 98.03%, at least 98.07%, at least 98.10%, at least 98.14%, at least 98.17%, at least 98.21%, at least 98.24%, at least 98.28%, at least 98.31%, at least 98.35%, at least 98.38%, at least 98.42%, at least 98.45%, at least 98.49%, at least 98.52%, at least 98.56%, at least 98.59%, at least 98.62%, at least 98.66%, at least 98.69%, at least 98.73%, at least 98.76%, at least 98.80%, at least 98.83%, at least 98.87%, at least 98.90%, at least 98.94%, at least 98.97%, at least 99.01%, at least 99.04%, at least 99.08%, at least 99.11%, at least 99.15%, at least 99.18%, at least 99.22%, at least 99.25%, at least 99.29%, at least 99.32%, at least 99.35%, at least 99.39%, at least 99.42%, at least 99.46%, at least 99.49%, at least 99.53%, at least 99.56%, at least 99.60%, at least 99.63%, at least 99.67%, at least 99.70%, at least 99.74%, at least 99.77%, at least 99.81%, at least 99.84%, at least 99.88%, at least 99.91%, at least 99.95%, at least 99.98%, or 100% identical) to SEQ ID NO: 9, and (e) a nucleic acid sequence that is at least 96.6% identical (e.g., at least 96.66%, at least 96.71%, at least 96.77%, at least 96.83%, at least 96.89%, at least 96.94%, at least 97.00%, at least 97.06%, at least 97.11%, at least 97.17%, at least 97.23%, at least 97.29%, at least 97.34%, at least 97.40%, at least 97.46%, at least 97.51%, at least 97.57%, at least 97.63%, at least 97.69%, at least 97.74%, at least 97.80%, at least 97.86%, at least 97.92%, at least 97.97%, at least 98.03%, at least 98.09%, at least 98.14%, at least 98.20%, at least 98.26%, at least 98.32%, at least 98.37%, at least 98.43%, at least 98.49%, at least 98.54%, at least 98.60%, at least 98.66%, at least 98.72%, at least 98.77%, at least 98.83%, at least 98.89%, at least 98.94%, at least 99.00%, at least 99.06%, at least 99.12%, at least 99.17%, at least 99.23%, at least 99.29%, at least 99.34%, at least 99.40%, at least 99.46%, at least 99.52%, at least 99.57%, at least 99.63%, at least 99.69%, at least 99.74%, at least at least 99.80%, at least 99.86%, at least 99.92%, at least 99.97%, or 100% identical) to SEQ ID NO: 10.

The adenovirus or adenoviral vector can comprise one, two, three, four, or all five of the aforementioned sequences alone or in any combination. In this respect, the adenovirus or adenoviral vector can comprise any combination of any two of the aforementioned sequences, any combination of any three of the aforementioned sequences, any combination of any four of the aforementioned sequences, or all five of the aforementioned sequences. For example, the adenovirus or adenoviral vector can comprise a nucleic acid sequence that is at least 98.6% identical to SEQ ID NO: 6. The adenovirus or adenoviral vector can comprise a nucleic acid sequence that is at least 99.06% identical to SEQ ID NO: 7 and a nucleic acid sequence that is at least 97.13% identical to SEQ ID NO: 8. The adenovirus or adenoviral vector can comprise a nucleic acid sequence that is at least 97.13% identical to SEQ ID NO: 8, a nucleic acid sequence that is at least 90.7% identical to SEQ ID NO: 9, and a nucleic acid sequence that is at least 96.6% identical to SEQ ID NO: 10. The adenovirus or adenoviral vector can comprise (a) the nucleic acid sequence of SEQ ID NO: 6, (b) the nucleic acid sequence SEQ ID NO: 7, (c) the nucleic acid sequence of SEQ ID NO: 8, (d) the nucleic acid sequence of SEQ ID NO: 9, or (e) the nucleic acid sequence of SEQ ID NO: 10. The adenovirus or adenoviral vector can comprise (a) a nucleic acid sequence that is at least 98.6% identical to SEQ ID NO: 6, (b) a nucleic acid sequence that is at least 99.06% identical to SEQ ID NO: 7, (c) a nucleic acid sequence that is at least 97.13% identical to SEQ ID NO: 8, (d) a nucleic acid sequence that is at least 90.7% identical to SEQ ID NO: 9, and (e) a nucleic acid sequence that is at least 96.6% identical to SEQ ID NO: 10. The adenovirus or adenoviral vector can comprise (a) the nucleic acid sequence of SEQ ID NO: 6, (b) the nucleic acid sequence SEQ ID NO: 7, (c) the nucleic acid sequence of SEQ ID NO: 8, (d) the nucleic acid sequence of SEQ ID NO: 9, and (e) the nucleic acid sequence of SEQ ID NO: 10.

In another embodiment, the adenovirus or adenoviral vector comprises one or more of the following nucleic acid sequences: (a) a nucleic acid sequence comprising at least 121 contiguous nucleotides of SEQ ID NO: 6, (b) a nucleic acid sequence comprising at least 462 contiguous nucleotides of SEQ ID NO: 7, (c) a nucleic acid sequence comprising at least 234 contiguous nucleotides of SEQ ID NO: 8, (d) a nucleic acid sequence comprising at least 606 contiguous nucleotides of SEQ ID NO: 9, or (e) a nucleic acid sequence comprising at least 188 contiguous nucleotides of SEQ ID NO: 10.

The adenovirus or adenoviral vector can comprise a nucleic acid sequence comprising at least 121 (e.g., 125 or more, 130 or more, 150 or more, 200 or more, 250 or more, or 300 or more) contiguous nucleotides of SEQ ID NO: 6, but no more than 399 (e.g., 398 or less, 350 or less, or 275 or less) contiguous nucleotides of SEQ ID NO: 6. Preferably, the adenovirus or adenoviral vector comprises a nucleic acid sequence comprising 121 to 300 contiguous nucleotides (e.g., 125, 150, 175, 200, 250, or 275 contiguous nucleotides), 121 to 200 contiguous nucleotides (e.g., 130, 140, 145, 160, 165, 170, 180, 185, 190, 195, or 199 contiguous nucleotides), or 121 to 150 contiguous nucleotides (e.g., 122, 123, 124, 125, 126, 127, 128, 129, 130, 131, 132, 133, 134, 135, 136, 137, 138, 139, 140, 141, 142, 143, 144, 145, 146, 147, 148, or 149 contiguous nucleotides) of SEQ ID NO: 6, or a range defined by any two of the foregoing values.

The adenovirus or adenoviral vector can comprise a nucleic acid sequence comprising at least 462 (e.g., 470 or more, 500 or more, 600 or more, 700 or more, 800 or more, 900 or more, or 1,000 or more) contiguous nucleotides of SEQ ID NO: 7, but no more than 3168 (e.g., 3,100 or less, 3,000 or less, 2,500 or less, 2,000 or less, or 1,500 or less) contiguous nucleotides of SEQ ID NO: 7. Preferably, the adenovirus or adenoviral vector comprises a nucleic acid sequence comprising 462 to 2,000 contiguous nucleotides (e.g., 475, 500, 700, 1,000, 1,200, 1,500, or 1,700 contiguous nucleotides), 462 to 1,000 contiguous nucleotides (e.g., 490, 525, 575, 600, 650, 675, 725, 750, 800, 850, 900, or 950 contiguous nucleotides), or 462 to 800 contiguous nucleotides (e.g., 480, 485, 490, 495, 499, 510, 515, 530, 540, 550, 560, 565, 570, 580, 585, 590, 595, 615, 625, 630, 640, 660, 665, 670, 680, 685, 690, 695, 705, 715, 730, 740, 755, 760, 765, 770, 775, 780, 785, 790, 795, or 799 contiguous nucleotides) of SEQ ID NO: 7, or a range defined by any two of the foregoing values.

The adenovirus or adenoviral vector can comprise a nucleic acid sequence comprising at least 234 (e.g., 235 or more, 250 or more, 300 or more, 350 or more, 400 or more, 450 or more, or 500 or more) contiguous nucleotides of SEQ ID NO: 8, but no more than 1,974 (e.g., 1,900 or less, 1,800 or less, 1,500 or less, 1,200 or less, 1,000 or less, 850 or less, 800 or less, 750 or less, or 700 or less) contiguous nucleotides of SEQ ID NO: 8. Preferably, the adenovirus or adenoviral vector comprises a nucleic acid sequence comprising 234 to 1,500 contiguous nucleotides (e.g., 290, 300, 400, 500, 600, 700, 800, 900, 1,000, or 1,200 contiguous nucleotides), 234 to 1,000 contiguous nucleotides (e.g., 295, 350, 450, 550, 650, 750, 850, or 950 contiguous nucleotides), or 234 to 500 contiguous nucleotides (e.g., 290, 305, 310, 315, 325, 340, 345, 360, 365, 370, 375, 380, 385, 390, 395, 405, 425, 430, 440, 455, 460, 465, 470, 475, 480, 485, 490, 495, or 499 contiguous nucleotides) of SEQ ID NO: 8, or a range defined by any two of the foregoing values.

The adenovirus or adenoviral vector can comprise a nucleic acid sequence comprising at least 606 (e.g., 610 or more, 650 or more, 700 or more, 800 or more, or 1,000 or more) contiguous nucleotides of SEQ ID NO: 9, but no more than 2877 (2,800 or less, 2,500 or less, 2,000 or less, 1,800 or less, or 1,500 or less) contiguous nucleotides of SEQ ID NO: 9. Preferably, the adenovirus or adenoviral vector comprises a nucleic acid sequence comprising 606 to 2,000 contiguous nucleotides (e.g., 615, 650, 700, 800, 900, 1,000, 1,200, 1,500, 1,700, or 1,900 contiguous nucleotides), 606 to 1,000 contiguous nucleotides (e.g., 630, 645, 665, 675, 725, 750, 775, 825, 850, 875, 925, 950, or 975 contiguous nucleotides), or 606 to 800 contiguous nucleotides (e.g., 620, 635, 640, 655, 660, 670, 680, 685, 690, 695, 699, 705, 715, 730, 735, 740, 745, 755, 760, 765, 770, 785, 790, 795, or 799 contiguous nucleotides) of SEQ ID NO: 9, or a range defined by any two of the foregoing values.

The adenovirus or adenoviral vector can comprise a nucleic acid sequence comprising at least 188 (e.g., 189 or more, 200 or more, 300 or more, 500 or more, 700 or more, or 900 or more) contiguous nucleotides of SEQ ID NO: 10, but no more than 1,749 (1,700 or less, 1,500 or less, 1,200 or less, or 1,000 or less) contiguous nucleotides of SEQ ID NO: 10. Preferably, the adenovirus or adenoviral vector comprises a nucleic acid sequence comprising 188 to 1,500 contiguous nucleotides (e.g., 200, 400, 600, 800, 1,000, 1,200, or 1,400 contiguous nucleotides), 188 to 1,000 contiguous nucleotides (e.g., 195, 250, 350, 450, 550, 650, 750, 850, or 950 contiguous nucleotides), or 188 to 500 contiguous nucleotides (e.g., 190, 225, 230, 240, 255, 260, 265, 270, 275, 315, 325, 330, 340, 355, 360, 365, 370, 375, 380, 385, 390, 395, 415, 425, 430, 440, 455, 460, 465, 470, 475, 480, 485, 490, 495, or 499 contiguous nucleotides) of SEQ ID NO: 10, or a range defined by any two of the foregoing values.

The adenovirus or adenoviral vector can comprise one, two, three, four, or all five of the aforementioned sequences alone, or in any combination. In this respect, the adenovirus or adenoviral vector can comprise any combination of any two of the aforementioned sequences, any combination of any three of the aforementioned sequences, any combination of any four of the aforementioned sequences, or all five of the aforementioned sequences. For example, the adenovirus or adenoviral vector can comprise a nucleic acid sequence comprising at least 121 contiguous nucleotides of SEQ ID NO: 6. The adenovirus or adenoviral vector can comprise a nucleic acid sequence comprising at least 234 contiguous nucleotides of SEQ ID NO: 8, and a nucleic acid sequence comprising at least 188 contiguous nucleotides of SEQ ID NO: 10. The adenovirus or adenoviral vector can comprise a nucleic acid sequence comprising at least 462 contiguous nucleotides of SEQ ID NO: 7, a nucleic acid sequence comprising at least 606 contiguous nucleotides of SEQ ID NO: 9, and a nucleic acid sequence comprising at least 188 contiguous nucleotides of SEQ ID NO: 10. The adenovirus or adenoviral vector can comprise a nucleic acid sequence comprising at least 121 contiguous nucleotides of SEQ ID NO: 6, a nucleic acid sequence comprising at least 462 contiguous nucleotides of SEQ ID NO: 7, a nucleic acid sequence comprising at least 234 contiguous nucleotides of SEQ ID NO: 8, and a nucleic acid sequence comprising at least 606 contiguous nucleotides of SEQ ID NO: 9. The adenovirus or adenoviral vector can comprise (a) a nucleic acid sequence comprising at least 121 contiguous nucleotides of SEQ ID NO: 6, (b) a nucleic acid sequence comprising at least 462 contiguous nucleotides of SEQ ID NO: 7, (c) a nucleic acid sequence comprising at least 234 contiguous nucleotides of SEQ ID NO: 8, (d) a nucleic acid sequence comprising at least 606 contiguous nucleotides of SEQ ID NO: 9, and (e) a nucleic acid sequence comprising at least 188 contiguous nucleotides of SEQ ID NO: 10.

In another embodiment, the adenovirus or adenoviral vector comprises one or more of the following amino acid sequences: (a) the amino acid sequence of SEQ ID NO: 11, (b) an amino acid sequence that is at least 82% identical (e.g., at least 88.67%, at least 95.33%, or 100% identical) to SEQ ID NO: 13, (c) an amino acid sequence that is at least 80% identical (e.g., at least 81%, at least 82%, at least 83%, at least 83.06%, at least 84%, at least 85%, at least 85.28%, at least 86%, at least 87%, at least 87.5%, at least 88%, at least 88.67%, at least 89%, at least 89.72% at least 90%, at least 91%, at least 91.94%, at least 92%, at least 92.33%, at least 93%, at least 94%, at least 94.17%, at least 95%, at least 95.33%, at least 95.67%, at least 96%, at least 96.39%, at least 97%, at least 98%, at least 98.61%, at least 99%, at least 99.5%, or 100% identical) to SEQ ID NO: 14, and (d) an amino acid sequence that is at least 83% identical (e.g., at least 89.67%, at least 96.33%, or 100% identical) to SEQ ID NO: 15.

The adenovirus or adenoviral vector can comprise one, two, three, or all four of the aforementioned amino acid sequences alone or in any combination. In this respect, the adenovirus or adenoviral vector can comprise any combination of any two of the aforementioned sequences, any combination of any three of the aforementioned sequences, or all four of the aforementioned sequences. For example, the adenovirus or adenoviral vector can comprise the amino acid sequence of SEQ ID NO: 11. The adenovirus or adenoviral vector can comprise an amino acid sequence of SEQ ID NO: 11, and an amino acid sequence that is at least 82% identical to SEQ ID NO: 13. The adenovirus or adenoviral vector can comprise the amino acid sequence of SEQ ID NO: 11, an amino acid sequence that is at least 82% identical to SEQ ID NO: 13, and an amino acid sequence that is at least 83% identical to SEQ ID NO: 15. The adenovirus or adenoviral vector can comprise (a) the amino acid sequence of SEQ ID NO: 11, (b) the amino acid sequence of SEQ ID NO: 13, (c) the amino acid sequence of SEQ ID NO: 14, or (d) the amino acid sequence of SEQ ID NO: 15. The adenovirus or adenoviral vector can comprise (a) the amino acid sequence of SEQ ID NO: 11, (b) an amino acid sequence that is at least 82% identical to SEQ ID NO: 13, (c) an amino acid sequence that is at least 80% identical to SEQ ID NO: 14, and (d) an amino acid sequence that is at least 83% identical to SEQ ID NO: 15. The adenovirus or adenoviral vector can comprise (a) the amino acid sequence of SEQ ID NO: 11, (b) the amino acid sequence of SEQ ID NO: 13, (c) the amino acid sequence of SEQ ID NO: 14, and (d) the amino acid sequence of SEQ ID NO: 15.

In another embodiment, the adenovirus or adenoviral vector comprises one or more of the following amino acid sequences: (a) the amino acid sequence of SEQ ID NO: 16, (b) an amino acid sequence that is at least 97.8% identical (e.g., at least 97.95%, at least 98.10%, at least 98.26%, at least 98.41%, at least 98.56%, at least 98.71%, at least 98.86%, at least 99.02%, at least 99.17%, at least 99.32%, at least 99.47%, at least 99.62%, at least 99.78%, or 100% identical) to SEQ ID NO: 18, (c) an amino acid sequence that is at least 93.4% identical (e.g., at least 93.50%, at least 93.61%, at least 93.71%, at least 93.82%, at least 93.92%, at least 94.03%, at least 94.13%, at least 94.23%, at least 94.34%, at least 94.44%, at least 94.55%, at least 94.65%, at least 94.76%, at least 94.86%, at least 94.96%, at least 95.07%, at least 95.17%, at least 95.28%, at least 95.38%, at least 95.49%, at least 95.59%, at least 95.69%, at least 95.80%, at least 95.90%, at least 96.01%, at least 96.11%, at least 96.22%, at least 96.32%, at least 96.42%, at least 96.53%, at least 96.63%, at least 96.74%, at least 96.84%, at least 96.95%, at least 97.05%, at least 97.15%, at least 97.26%, at least 97.36%, at least 97.47%, at least 97.57%, at least 97.68%, at least 97.78%, at least 97.88%, at least 97.99%, at least 98.09%, at least 98.20%, at least 98.30%, at least 98.41%, at least 98.51%, at least 98.61%, at least 98.72%, at least 98.82%, at least 98.93%, at least 99.03%, at least 99.14%, at least 99.24%, at least 99.34%, at least 99.45%, at least 99.55%, at least 99.66%, at least 99.76%, at least 99.87%, at least 99.97%, or 100% identical) to SEQ ID NO: 19, and (d) an amino acid sequence that is at least 98.2% identical (e.g., at least 98.37%, at least 98.54%, at least 98.71%, at least 98.89%, at least 99.06%, at least 99.23%, at least 99.40%, at least 99.57%, at least 99.74%, at least 99.92%, or 100% identical) to SEQ ID NO: 20.

The adenovirus or adenoviral vector can comprise one, two, three, or all four of the aforementioned amino acid sequences alone or in any combination. In this respect, the adenovirus or adenoviral vector can comprise any combination of any two of the aforementioned sequences, any combination of any three of the aforementioned sequences, or all four of the aforementioned sequences. For example, the adenovirus or adenoviral vector can comprise the amino acid sequence of SEQ ID NO: 16. The adenovirus or adenoviral vector can comprise the amino acid sequence of SEQ ID NO: 16, and an amino acid sequence that is at least 93.4% identical to SEQ ID NO: 19. The adenovirus or adenoviral vector can comprise the amino acid sequence of SEQ ID NO: 16, an amino acid sequence that is at least 93.4% identical to SEQ ID NO: 19, and an amino acid sequence that is at least 98.2% identical to SEQ ID NO: 20. The adenovirus or adenoviral vector can comprise (a) the amino acid sequence of SEQ ID NO: 16, (b) the amino acid sequence of SEQ ID NO: 18, (c) the amino acid sequence of SEQ ID NO: 19, or (d) the amino acid sequence of SEQ ID NO: 20. The adenovirus or adenoviral vector can comprise (a) the amino acid sequence of SEQ ID NO: 16, (b) an amino acid sequence that is at least 97.8% identical to SEQ ID NO: 18, (c) an amino acid that is at least 93.4% identical to SEQ ID NO: 19, and (d) an amino acid sequence that is at least 98.2% identical to SEQ ID NO: 20. The adenovirus or adenoviral vector can comprise (a) the amino acid sequence of SEQ ID NO: 16, (b) the amino acid sequence of SEQ ID NO: 18, (c) the amino acid sequence of SEQ ID NO: 19, and (d) the amino acid sequence of SEQ ID NO: 20.

In another embodiment, the adenovirus or adenoviral vector comprises one or more of the following amino acid sequences: (a) an amino acid sequence comprising at least 89 contiguous amino acid residues of SEQ ID NO: 16, (b) an amino acid sequence comprising at least 247 contiguous amino acid residues of SEQ ID NO: 18, (c) an amino acid sequence comprising at least 370 contiguous amino acid residues of SEQ ID NO: 19, and (d) an amino acid sequence comprising at least 192 contiguous amino acid residues of SEQ ID NO: 20.

The adenovirus or adenoviral vector can comprise an amino acid sequence comprising at least 89 (e.g., 90 or more, 100 or more, or 110 or more) contiguous amino acid residues of SEQ ID NO: 16, but no more than 133 (e.g., 130 or less, 125 or less, 120 or less, or 115 or less) contiguous amino acid residues of SEQ ID NO: 16. Preferably, the adenovirus or adenoviral vector comprises an amino acid sequence comprising 89 to 130 contiguous amino acid residues (e.g., 90, 100, 110, 115, 120, or 125 contiguous amino acid residues) of SEQ ID NO: 16, 89 to 115 contiguous amino acid residues of SEQ ID NO: 16 (e.g., 95, 110, or 112 contiguous amino acid residues), or 89 to 100 contiguous amino acid residues (e.g., 89, 90, 91, 92, 93, 94, 95, 96, 97, 98, or 99 contiguous amino acid residues) of SEQ ID NO: 16, or a range defined by any two of the foregoing values.

The adenovirus or adenoviral vector can comprise an amino acid sequence comprising at least 247 (e.g., 250 or more, 275 or more, 300 or more, or 400 or more) contiguous amino acid residues of SEQ ID NO: 18, but no more than 658 (e.g., 650 or less, 550 or less, or 450 or less) contiguous amino acid residues of SEQ ID NO: 18. Preferably, the adenovirus or adenoviral vector comprises an acid sequence comprising 247 to 600 contiguous amino acid residues (e.g., 255, 275, 300, 400, or 500 contiguous amino acid residues) of SEQ ID NO: 18, 247 to 500 contiguous amino acid residues of SEQ ID NO: 18 (e.g., 325, 350, 375, 425, 450, or 475 contiguous amino acid residues), or 247 to 400 contiguous amino acid residues (e.g., 265, 280, 285, 290, 295, 360, 365, 380, 385, 390, 395, or 399 contiguous amino acid residues) of SEQ ID NO: 18, or a range defined by any two of the foregoing values.

The adenovirus or adenoviral vector can comprise an amino acid sequence comprising at least 370 (e.g., 380 or more, 400 or more, or 500 or more) contiguous amino acid residues of SEQ ID NO: 19, but no more than 959 (e.g., 950 or less, 900 or less, 800 or less, 700 or less, or 600 or less) contiguous amino acid residues of SEQ ID NO: 19. Preferably, the adenovirus or adenoviral vector comprises an acid sequence comprising 370 to 800 contiguous amino acid residues (e.g., 390, 400, 500, 600, or 700 contiguous amino acid residues) of SEQ ID NO: 19, 370 to 600 contiguous amino acid residues (e.g., 375, 385, 395, 425, 445, 450, 465, 475, 525, 545, 550, 565 or 575 contiguous amino acid residues) of SEQ ID NO: 19, or 370 to 500 contiguous amino acid residues (e.g., 385, 389, 395, 399, 415, 435, 440, 460, 470, 480, or 499 contiguous amino acid residues) of SEQ ID NO: 19, or a range defined by any two of the foregoing values.

The adenovirus or adenoviral vector can comprise an amino acid sequence comprising at least 192 (e.g., 193 or more, 200 or more, or 300 or more) contiguous amino acid residues of SEQ ID NO: 20, but no more than 583 (e.g., 580 or less, 550 or less, 500 or less, 450 or less, or 400 or less) contiguous amino acid residues of SEQ ID NO: 20. Preferably, the adenovirus or adenoviral vector comprises an acid sequence comprising 192 to 500 contiguous amino acid residues (e.g., 198, 200, 300, or 400 contiguous amino acid residues) of SEQ ID NO: 20, 192 to 300 contiguous amino acid residues (e.g., 194, 196, 200, 210, 220, 230, 240, 250, 260, 270, 280, or 290 contiguous amino acid residues) of SEQ ID NO: 20, or 192 to 250 contiguous amino acid residues (e.g., 195, 199, 215, 225, 235, or 245 contiguous amino acid residues) of SEQ ID NO: 20, or a range defined by any two of the foregoing values.

The adenovirus or adenoviral vector can comprise one, two, three, or all four of the aforementioned amino acid sequences alone or in any combination. In this respect, the adenovirus or adenoviral vector can comprise any combination of any two of the aforementioned sequences, any combination of any three of the aforementioned sequences, or all four of the aforementioned sequences. For example, the adenovirus or adenoviral vector can comprise an amino acid sequence comprising at least 89 contiguous amino acid residues of SEQ ID NO: 16. The adenovirus or adenoviral vector can comprise an amino acid sequence comprising at least 89 contiguous amino acid residues of SEQ ID NO: 16, and an amino acid sequence comprising at least 370 contiguous amino acid residues of SEQ ID NO: 19. The adenovirus or adenoviral vector can comprise an amino acid sequence comprising at least 89 contiguous amino acid residues of SEQ ID NO: 16, an amino acid sequence comprising at least 247 contiguous amino acid residues of SEQ ID NO: 18, and an amino acid sequence comprising at least 370 contiguous amino acid residues of SEQ ID NO: 19. The adenovirus or adenoviral vector can comprise an amino acid sequence comprising at least 89 contiguous amino acid residues of SEQ ID NO: 16, an amino acid sequence comprising at least 247 contiguous amino acid residues of SEQ ID NO: 18, and an amino acid sequence comprising at least 192 contiguous amino acid residues of SEQ ID NO: 20. The adenovirus or adenoviral vector can comprise (a) an amino acid sequence comprising at least 89 contiguous amino acid residues of SEQ ID NO: 16, (b) an amino acid sequence comprising at least 247 contiguous amino acid residues of SEQ ID NO: 18, (c) an amino acid sequence comprising at least 370 contiguous amino acid residues of SEQ ID NO: 19, and (d) an amino acid sequence comprising at least 192 contiguous amino acid residues of SEQ ID NO: 20.

In other embodiments, the adenovirus or adenoviral vector comprises one or more nucleic acid sequences that encode one or more of any of the aforementioned amino acid sequences, e.g., the amino acid sequences of any of SEQ ID NOs: 11-20 or any of the variants and/or portions thereof as described herein. For example, the adenovirus or adenoviral vector can comprise a nucleic acid sequence encoding an amino acid sequence that is at least 99.78% identical (e.g., at least 99.87%, at least 99.97%, or 100% identical) to SEQ ID NO: 17, or a nucleic acid sequence encoding an amino acid sequence that is at least 99% identical (e.g., at least 99.68% or 100% identical) to SEQ ID NO: 12.

In one embodiment, the adenovirus or adenoviral vector comprises one or more of the following nucleic acid sequences: (a) a nucleic acid sequence that is at least 96% identical (e.g., at least 96% or 100% identical) to SEQ ID NO: 27, (b) a nucleic acid sequence that is at least 99% identical (e.g., at least 99.08%, at least 99.16%, at least 99.23%, at least 99.31%, at least 99.39%, at least 99.47%, at least 99.55%, at least 99.62%, at least 99.70%, at least 99.78%, at least 99.86%, at least 99.93%, or 100% identical) to SEQ ID NO: 28, (c) a nucleic acid sequence that is at least 80% identical (e.g., at least 82%, at least 84.22%, at least 86.44%, at least 88.67%, at least 90.89%, at least 93.11%, at least 95.33%, at least 97.56%, at least 99.78%, or 100% identical) to SEQ ID NO: 29, (d) a nucleic acid sequence that is at least 80% identical (e.g., at least 80.58%, at least 82.67%, at least 84.75%, at least 86.83%, at least 88.92%, at least 91.00%, at least 93.08%, at least 95.17%, at least 97.25%, at least 99.33%, or 100% identical) to SEQ ID NO: 30, and (e) a nucleic acid sequence that is at least 85.4% identical (e.g., at least 87.48%, at least 89.57%, at least 91.65%, at least 93.73%, at least 95.82%, at least 97.90%, at least 99.98%, or 100% identical) to SEQ ID NO: 31.

The adenovirus or adenoviral vector can comprise one, two, three, four, or all five of the aforementioned sequences alone or in any combination. In this respect, the adenovirus or adenoviral vector can comprise any combination of any two of the aforementioned sequences, any combination of any three of the aforementioned sequences, any combination of any four of the aforementioned sequences, or all five of the aforementioned sequences. For example, the adenovirus or adenoviral vector can comprise a nucleic acid sequence that is at least 96% identical to SEQ ID NO: 27. The adenovirus or adenoviral vector can comprise a nucleic acid sequence that is at least 99% identical to SEQ ID NO: 28 and a nucleic acid sequence that is at least 80% identical to SEQ ID NO: 29. The adenovirus or adenoviral vector can comprise a nucleic acid sequence that is at least 96% identical to SEQ ID NO: 27, a nucleic acid sequence that is at least 80% identical to SEQ ID NO: 29, and a nucleic acid sequence that is at least 85.4% identical to SEQ ID NO: 31. The adenovirus or adenoviral vector can comprise (a) the nucleic acid sequence of SEQ ID NO: 27, (b) the nucleic acid sequence SEQ ID NO: 28, (c) the nucleic acid sequence of SEQ ID NO: 29, (d) the nucleic acid sequence of SEQ ID NO: 30, or (e) the nucleic acid sequence of SEQ ID NO: 31. The adenovirus or adenoviral vector can comprise (a) a nucleic acid sequence that is at least 96% identical to SEQ ID NO: 27, (b) a nucleic acid sequence that is at least 99% identical to SEQ ID NO: 28, (c) a nucleic acid sequence that is at least 80% identical to SEQ ID NO: 29, (d) a nucleic acid sequence that is at least 80% identical to SEQ ID NO: 30, and (e) a nucleic acid sequence that is at least 85.4% identical to SEQ ID NO: 31. The adenovirus or adenoviral vector can comprise (a) the nucleic acid sequence of SEQ ID NO: 27, (b) the nucleic acid sequence SEQ ID NO: 28, (c) the nucleic acid sequence of SEQ ID NO: 29, (d) the nucleic acid sequence of SEQ ID NO: 30, and (e) the nucleic acid sequence of SEQ ID NO: 31.

In another embodiment, the adenovirus or adenoviral vector comprises one or more of the following nucleic acid sequences: (a) a nucleic acid sequence that is at least 98.7% identical (e.g., at least 98.95%, at least 99.20%, at least 99.45%, at least 99.70%, at least 99.95%, or 100% identical) to SEQ ID NO: 32, (b) a nucleic acid sequence that is at least 98.9% identical (e.g., at least 99.15%, at least 99.40%, at least 99.65%, at least 99.90%, or 100% identical) to SEQ ID NO: 33, (c) a nucleic acid sequence that is at least 99.4% identical (e.g., at least 99.65%, at least 99.90%, or 100% identical) to SEQ ID NO: 34, (d) a nucleic acid sequence that is at least 99.1% identical (e.g., at least 99.13%, at least 99.16%, at least 99.19%, at least 99.23%, at least 99.26%, at least 99.29%, at least 99.32%, at least 99.35%, at least 99.38%, at least 99.42%, at least 99.45%, at least 99.48%, at least 99.51%, at least 99.54%, at least 99.57%, at least 99.61%, at least 99.64%, at least 99.67%, at least 99.70%, at least 99.73%, at least 99.76%, at least 99.79%, at least 99.83%, at least 99.86%, at least 99.89%, at least 99.92%, at least 99.95%, at least 99.98%, or 100% identical) to SEQ ID NO: 35, (e) a nucleic acid sequence that is at least 81.25% identical (e.g., at least 81.30%, at least 81.36%, at least 81.41%, at least 81.46%, at least 81.52%, at least 81.57%, at least 81.63%, at least 81.68%, at least 81.73%, at least 81.79%, at least 81.84%, at least 81.89%, at least 81.95%, at least 82.00%, at least 82.06%, at least 82.11%, at least 82.16%, at least 82.22%, at least 82.27%, at least 82.32%, at least 82.38%, at least 82.43%, at least 82.48%, at least 82.54%, at least 82.59%, at least 82.65%, at least 82.70%, at least 82.75%, at least 82.81%, at least 82.86%, at least 82.91%, at least 82.97%, at least 83.02, at least 83.08%, at least 83.13%, at least 83.18%, at least 83.24%, at least 83.29%, at least 83.34%, at least 83.40%, at least 83.45%, at least 83.50%, at least 83.56%, at least 83.61%, at least 83.67%, at least 83.72%, at least 83.77%, at least 83.83%, at least 83.88%, at least 83.93%, at least 83.99%, at least 84.04%, at least 84.09%, at least 84.15%, at least 84.20%, at least 84.26%, at least 84.31%, at least 84.36%, at least 84.42%, at least 84.47%, at least 84.52%, at least 84.58%, at least 84.63%, at least 84.69%, at least 84.74%, at least 84.79%, at least 84.85%, at least 84.90%, at least 84.95%, at least 85.01%, at least 85.06%, at least 85.11%, at least 85.17%, at least 85.22%, at least 85.28%, at least 85.33%, at least 85.38%, at least 85.44%, at least 85.49%, at least 85.54%, at least 85.60%, at least 85.65%, at least 85.71%, at least 85.76%, at least 85.81%, at least 85.87%, at least 85.92%, at least 85.97%, at least 86.03%, at least 86.08%, at least 86.13%, at least 86.19%, at least 86.24%, at least 86.30%, at least 86.35%, at least 86.40%, at least 86.46%, at least 86.51%, at least 86.56%, at least 86.62%, at least 86.67%, at least 86.73%, at least 86.78%, at least 86.83%, at least 86.89%, at least 86.94%, at least 86.99%, at least 87.05%, at least 87.10%, at least 87.15%, at least 87.21%, at least 87.26%, at least 87.32%, at least 87.37%, at least 87.42%, at least 87.48%, at least 87.53%, at least 87.58%, at least 87.64%, at least 87.69%, at least 87.74%, at least 87.80%, at least 87.85%, at least 87.91%, at least 87.96%, at least 88.01%, at least 88.07%, at least 88.12%, at least 88.17%, at least 88.23%, at least 88.28%, at least 88.34%, at least 88.39%, at least 88.44%, at least 88.50%, at least 88.55%, at least 88.60%, at least 88.66%, at least 88.71%, at least 88.76%, at least 88.82%, at least 88.87%, at least 88.93%, at least at least 88.98%, at least 89.03%, at least 89.09%, at least 89.14%, at least 89.19%, at least 89.25%, at least 89.30%, 89.36%, at least 89.41%, at least 89.46%, at least 89.52%, at least 89.57%, at least 89.62%, at least 89.68%, at least 89.73%, at least 89.78%, at least 89.84%, at least 89.89%, at least 89.95%, at least 90.00%, at least 90.05%, at least 90.11%, at least 90.16%, at least 90.21%, at least 90.27%, at least 90.32%, at least 90.38%, at least 90.43%, at least 90.48%, at least 90.54%, at least 90.59%, at least 90.64%, at least 90.70%, at least 90.75%, at least 90.80%, at least 90.86%, at least 90.91%, at least 90.97%, at least 91.02%, at least 91.07%, at least 91.13%, at least 91.18%, at least 91.23%, at least 91.29%, at least 91.34%, at least 91.39%, at least 91.45%, at least 91.50%, at least 91.56%, at least 91.61%, at least 91.66%, at least 91.72%, at least 91.77%, at least 91.82%, at least 91.88%, at least 91.93%, at least 91.99%, at least 92.04%, at least 92.09%, at least 92.15%, at least 92.20%, at least 92.25%, at least 92.31%, at least 92.36%, at least 92.41%, at least 92.47%, at least 92.52%, at least 92.58%, at least 92.63%, at least 92.68%, at least 92.74%, at least 92.79%, at least 92.84%, at least 92.90%, at least 92.95%, at least 93.01%, at least 93.06%, at least 93.11%, at least 93.17%, at least 93.22%, at least 93.27%, at least 93.33%, at least 93.38%, at least 93.43%, at least 93.49%, at least 93.54%, at least 93.60%, at least 93.65%, at least 93.70%, at least 93.76%, at least 93.81%, at least 93.86%, at least 93.92%, at least 93.97%, at least 94.03%, at least 94.08%, at least 94.13%, at least 94.19%, at least 94.24%, at least 94.29%, at least 94.35%, at least 94.40%, at least 94.45%, at least 94.51%, at least 94.56%, at least 94.62%, at least 94.67%, at least 94.72%, at least 94.78%, at least 94.83%, at least 94.88%, at least 94.94%, at least 94.99%, at least 95.04%, at least 95.10%, at least 95.15%, at least 95.21%, at least 95.26%, at least 95.31%, at least 95.37%, at least 95.42%, at least 95.47%, at least 95.53%, at least 95.58%, at least 95.64%, at least 95.69%, at least 95.74%, at least 95.80%, at least 95.85%, at least 95.90%, at least 95.96%, at least 96.01%, at least 96.06%, at least 96.12%, at least 96.17%, at least 96.23%, at least 96.28%, at least 96.33%, at least 96.39%, at least 96.44%, at least 96.49%, at least 96.55%, at least 96.60%, at least 96.66%, at least 96.71%, at least 96.76%, at least 96.82%, at least 96.87%, at least 96.92%, at least 96.98%, at least 97.03%, at least 97.08%, at least 97.14%, at least 97.19%, at least 97.25%, at least 97.30%, at least 97.35%, at least 97.41%, at least 97.46%, at least 97.51%, at least 97.57%, at least 97.62%, at least 97.68%, at least 97.73%, at least 97.78%, at least 97.84%, at least 97.89%, at least 97.94%, at least 98.00%, at least 98.05%, at least 98.10%, at least 98.16%, at least 98.21%, at least 98.27%, at least 98.32%, at least 98.37%, at least 98.43%, at least 98.48%, at least 98.53%, at least 98.59%, at least 98.64%, at least 98.69%, at least 98.75%, at least 98.80%, at least 98.86%, at least 98.91%, at least 98.96%, at least 99.02%, at least 99.07%, at least 99.12%, at least 99.18%, at least 99.23%, at least 99.29%, at least 99.34%, at least 99.39%, at least 99.45%, at least 99.50%, at least 99.55%, at least 99.61%, at least 99.66%, at least 99.71%, at least 99.77%, at least 99.82%, at least 99.88%, at least 99.93%, at least 99.98%, or 100% identical) to SEQ ID NO: 36, (f) a nucleic acid sequence that is at least 90.83% identical (e.g., at least 90.87%, at least 90.90%, at least 90.94%, at least 90.97%, at least 91.01%, at least 91.04%, at least 91.08%, at least 91.11%, at least 91.15%, at least 91.18%, at least 91.22%, at least 91.25%, at least 91.29%, at least 91.32%, at least 91.36%, at least 91.39%, at least 91.43%, at least 91.46%, at least 91.50%, at least 91.53%, at least 91.57%, at least 91.60%, at least 91.64%, at least 91.67%, at least 91.71%, at least 91.75%, at least 91.78%, at least 91.82%, at least 91.85%, at least 91.89%, at least 91.92%, at least 91.96%, at least 91.99%, at least 92.03%, at least 92.06%, at least 92.10%, at least 92.13%, at least 92.17%, at least 92.20%, at least 92.24%, at least 92.27%, at least 92.31%, at least 92.34%, at least 92.38%, at least 92.41%, at least 92.45%, at least 92.48%, at least 92.52%, at least 92.55%, at least 92.59%, at least 92.63%, at least 92.66%, at least 92.70%, at least 92.73%, at least 92.77%, at least 92.80%, at least 92.84%, at least 92.87%, at least 92.91%, at least 92.94%, at least 92.98%, at least 93.01%, at least 93.05%, at least 93.08%, at least 93.12%, at least 93.15%, at least 93.19%, at least 93.22%, at least 93.26%, at least 93.29%, at least 93.33%, at least 93.36%, at least 93.40%, at least 93.43%, at least 93.47%, at least 93.51%, at least 93.54%, at least 93.58%, at least 93.61%, at least 93.65%, at least 93.68%, at least 93.72%, at least 93.75%, at least 93.79%, at least 93.82%, at least 93.86%, at least 93.89%, at least 93.93%, at least 93.96%, at least 94.00%, at least 94.03%, at least 94.07%, at least 94.10%, at least 94.14%, at least 94.17%, at least 94.21%, at least 94.24%, at least 94.28%, at least 94.31%, at least 94.35%, at least 94.39%, at least 94.42%, at least 94.46%, at least 94.49%, at least 94.53%, at least 94.56%, at least 94.60%, at least 94.63%, at least 94.67%, at least 94.70%, at least 94.74%, at least 94.77%, at least 94.81%, at least 94.84%, at least 94.88%, at least 94.91%, at least 94.95%, at least 94.98%, at least 95.02%, at least 95.05%, at least 95.09%, at least 95.12%, at least 95.16%, at least 95.19%, at least 95.23%, at least 95.27%, at least 95.30%, at least 95.34%, at least 95.37%, at least 95.41%, at least 95.44%, at least 95.48%, at least 95.51%, at least 95.55%, at least 95.58%, at least 95.62%, at least 95.65%, at least 95.69%, at least 95.72%, at least 95.76%, at least 95.79%, at least 95.83%, at least 95.86%, at least 95.90%, at least 95.93%, at least 95.97%, at least 96.00%, at least 96.04%, at least 96.07%, at least 96.11%, at least 96.15%, at least 96.18%, at least 96.22%, at least 96.25%, at least 96.29%, at least 96.32%, at least 96.36%, at least 96.39%, at least 96.43%, at least 96.46%, at least 96.50%, at least 96.53%, at least 96.57%, at least 96.60%, at least 96.64%, at least 96.67%, at least 96.71%, at least 96.74%, at least 96.78%, at least 96.81%, at least 96.85%, at least 96.88%, at least 96.92%, at least 96.95%, at least 96.99%, at least 97.03%, at least 97.06%, at least 97.10%, at least 97.13%, at least 97.17%, at least 97.20%, at least 97.24%, at least 97.27%, at least 97.31%, at least 97.34%, at least 97.38%, at least 97.41%, at least 97.45%, at least 97.48%, at least 97.52%, at least 97.55%, at least 97.59%, at least 97.62%, at least 97.66%, at least 97.69%, at least 97.73%, at least 97.76%, at least 97.80%, at least 97.83%, at least 97.87%, at least 97.90%, at least 97.94%, at least 97.98%, at least 98.01%, at least 98.05%, at least 98.08%, at least 98.12%, at least 98.15%, at least 98.19%, at least 98.22%, at least 98.26%, at least 98.29%, at least 98.33%, at least 98.36%, at least 98.40%, at least 98.43%, at least 98.47%, at least 98.50%, at least 98.54%, at least 98.57%, at least 98.61%, at least 98.64%, at least 98.68%, at least 98.71%, at least 98.75%, at least 98.78%, at least 98.82%, at least 98.86%, at least 98.89%, at least 98.93%, at least 98.96%, at least 99.00%, at least 99.03%, at least 99.07%, at least 99.10%, at least 99.14%, at least 99.17%, at least 99.21%, at least 99.24%, at least 99.28%, at least 99.31%, at least 99.35%, at least 99.38%, at least 99.42%, at least 99.45%, at least 99.49%, at least 99.52%, at least 99.56%, at least 99.59%, at least 99.63%, at least 99.66%, at least 99.70%, at least 99.74%, at least 99.77%, at least 99.81%, at least 99.84%, at least 99.88%, at least 99.91%, at least 99.95%, at least 99.98%, or 100% identical) to SEQ ID NO: 37, and (g) a nucleic acid sequence that is at least 82.5% identical (e.g., at least 82.56%, at least 82.61%, at least 82.67%, at least 82.73%, at least 82.79%, at least 82.84%, at least 82.90%, at least 82.96%, at least 83.02%, at least 83.07%, at least 83.13%, at least 83.19%, at least 83.25%, at least 83.30%, at least 83.36%, at least 83.42%, at least 83.48%, at least 83.53%, at least 83.59%, at least 83.65%, at least 83.71%, at least 83.76%, at least 83.82%, at least 83.88%, at least 83.94%, at least 83.99%, at least 84.05%, at least 84.11%, at least 84.17%, at least 84.22%, at least 84.28%, at least 84.34%, at least 84.40%, at least 84.45%, at least 84.51%, at least 84.57%, at least 84.63%, at least 84.68%, at least 84.74%, at least 84.80%, at least 84.86%, at least 84.91%, at least 84.97%, at least 85.03%, at least 85.09%, at least 85.14%, at least 85.20%, at least 85.26%, at least 85.32%, at least 85.37%, at least 85.43%, at least 85.49%, at least 85.55%, at least 85.60%, at least 85.66%, at least 85.72%, at least 85.78%, at least 85.83%, at least 85.89%, at least 85.95%, at least 86.01%, at least 86.06%, at least 86.12%, at least 86.18%, at least 86.24%, at least 86.29%, at least 86.35%, at least 86.41%, at least 86.47%, at least 86.52%, at least 86.58%, at least 86.64%, at least 86.70%, at least 86.75%, at least 86.81%, at least 86.87%, at least 86.93%, at least 86.98%, at least 87.04%, at least 87.10%, at least 87.16%, at least 87.21%, at least 87.27%, at least 87.33%, at least 87.39%, at least 87.44%, at least 87.50%, at least 87.56%, at least 87.61%, at least 87.67%, at least 87.73%, at least 87.79%, at least 87.84%, at least 87.90%, at least 87.96%, at least 88.02%, at least 88.07%, at least 88.13%, at least 88.19%, at least 88.25%, at least 88.30%, at least 88.36%, at least 88.42%, at least 88.48%, at least 88.53%, at least 88.59%, at least 88.65%, at least 88.71%, at least 88.76%, at least 88.82%, at least 88.88%, at least 88.94%, at least 88.99%, at least 89.05%, at least 89.11%, at least 89.17%, at least 89.22%, at least 89.28%, at least 89.34%, at least 89.40%, at least 89.45%, at least 89.51%, at least 89.57%, at least 89.63%, at least 89.68%, at least 89.74%, at least 89.80%, at least 89.86%, at least 89.91%, at least 89.97%, at least 90.03%, at least 90.09%, at least 90.14%, at least 90.20%, at least 90.26%, at least 90.32%, at least 90.37%, at least 90.43%, at least 90.49%, at least 90.55%, at least 90.60%, at least 90.66%, at least 90.72%, at least 90.78%, at least 90.83%, at least 90.89%, at least 90.95%, at least 91.01%, at least 91.06%, at least 91.12%, at least 91.18%, at least 91.24%, at least 91.29%, at least 91.35%, at least 91.41%, at least 91.47%, at least 91.52%, at least 91.58%, at least 91.64%, at least 91.70%, at least 91.75%, at least 91.81%, at least 91.87%, at least 91.93%, at least 91.98%, at least 92.04%, at least 92.10%, at least 92.16%, at least 92.21%, at least 92.27%, at least 92.33%, at least 92.39%, at least 92.44%, at least 92.50%, at least 92.56%, at least 92.61%, at least 92.67%, at least 92.73%, at least 92.79%, at least 92.84%, at least 92.90%, at least 92.96%, at least 93.02%, at least 93.07%, at least 93.13%, at least 93.19%, at least 93.25%, at least 93.30%, at least 93.36%, at least 93.42%, at least 93.48%, at least 93.53%, at least 93.59%, at least 93.65%, at least 93.71%, at least 93.76%, at least 93.82%, at least 93.88%, at least 93.94%, at least 93.99%, at least 94.05%, at least 94.11%, at least 94.17%, at least 94.22%, at least 94.28%, at least 94.34%, at least 94.40%, at least 94.45%, at least 94.51%, at least 94.57%, at least 94.63%, at least 94.68%, at least 94.74%, at least 94.80%, at least 94.86%, at least 94.91%, at least 94.97%, at least 95.03%, at least 95.09%, at least 95.14%, at least 95.20%, at least 95.26%, at least 95.32%, at least 95.37%, at least 95.43%, at least 95.49%, at least 95.55%, at least 95.60%, at least 95.66%, at least 95.72%, at least 95.78%, at least 95.83%, at least 95.89%, at least 95.95%, at least 96.01%, at least 96.06%, at least 96.12%, at least 96.18%, at least 96.24%, at least 96.29%, at least 96.35%, at least 96.41%, at least 96.47%, at least 96.52%, at least 96.58%, at least 96.64%, at least 96.70%, at least 96.75%, at least 96.81%, at least 96.87%, at least 96.93%, at least 96.98%, at least 97.04%, at least 97.10%, at least 97.16%, at least 97.21%, at least 97.27%, at least 97.33%, at least 97.39%, at least 97.44%, at least 97.50%, at least 97.56%, at least 97.61%, at least 97.67%, at least 97.73%, at least 97.79%, at least 97.84%, at least 97.90%, at least 97.96%, at least 98.02%, at least 98.07%, at least 98.13%, at least 98.19%, at least 98.25%, at least 98.30%, at least 98.36%, at least 98.42%, at least 98.48%, at least 98.53%, at least 98.59%, at least 98.65%, at least 98.71%, at least 98.76%, at least 98.82%, at least 98.88%, at least 98.94%, at least 98.99%, at least 99.05%, at least 99.11%, at least 99.17%, at least 99.22%, at least 99.28%, at least 99.34%, at least 99.40%, at least 99.45%, at least 99.51%, at least 99.57%, at least 99.63%, at least 99.68%, at least 99.74%, at least 99.80%, at least 99.86%, at least 99.91%, at least 99.97%, or 100% identical) to SEQ ID NO: 38.

The adenovirus or adenoviral vector can comprise one, two, three, four, five, six or all seven of the aforementioned sequences alone or in any combination. In this respect, the adenovirus or adenoviral vector can comprise any combination of any two of the aforementioned sequences, any combination of any three of the aforementioned sequences, any combination of any four of the aforementioned sequences, any combination of any five of the aforementioned sequences, or all six of the aforementioned sequences. For example, the adenovirus or adenoviral vector can comprise a nucleic acid sequence that is at least 98.7% identical to SEQ ID NO: 32. The adenovirus or adenoviral vector can comprise a nucleic acid sequence that is at least 81.25% identical to SEQ ID NO: 36 and a nucleic acid sequence that is at least 82.50% identical to SEQ ID NO: 38. The adenovirus or adenoviral vector can comprise a nucleic acid sequence that is at least 99.4% identical to SEQ ID NO: 34, a nucleic acid sequence that is at least 99.1% identical to SEQ ID NO: 35, a nucleic acid sequence that is at least 81.25% identical to SEQ ID NO: 36, and a nucleic acid sequence that is at least 82.5% identical to SEQ ID NO: 38. The adenovirus or adenoviral vector can comprise (a) the nucleic acid sequence of SEQ ID NO: 32, (b) the nucleic acid sequence of SEQ ID NO: 35, (c) the nucleic acid sequence of SEQ ID NO: 36, (d) the nucleic acid sequence of SEQ ID NO: 37, or (e) the nucleic acid sequence of SEQ ID NO: 38. The adenovirus or adenoviral vector can comprise (a) a nucleic acid sequence that is at least 99.4% identical to SEQ ID NO: 34, (b) a nucleic acid sequence that is at least 99.1% identical to SEQ ID NO: 35, (c) a nucleic acid sequence that is at least 81.25% identical to SEQ ID NO: 36, (d) a nucleic acid sequence that is at least 90.83% identical to SEQ ID NO: 37, and (e) a nucleic acid sequence that is at least 82.5% identical to SEQ ID NO: 38. The adenovirus or adenoviral vector can comprise (a) the nucleic acid sequence SEQ ID NO: 33, (b) the nucleic acid sequence of SEQ ID NO: 35, (c) the nucleic acid sequence of SEQ ID NO: 36, (d) the nucleic acid sequence of SEQ ID NO: 37, and (e) the nucleic acid sequence of SEQ ID NO: 38.

In another embodiment, the adenovirus or adenoviral vector comprises one or more of the following nucleic acid sequences: (a) a nucleic acid sequence comprising at least 162 contiguous nucleotides of SEQ ID NO: 32, (b) a nucleic acid sequence comprising at least 162 contiguous nucleotides of SEQ ID NO: 33, (c) a nucleic acid sequence comprising at least 121 contiguous nucleotides of SEQ ID NO: 34, (d) a nucleic acid sequence comprising at least 531 contiguous nucleotides of SEQ ID NO: 35, (e) a nucleic acid sequence comprising at least 156 contiguous nucleotides of SEQ ID NO: 36, (f) a nucleic acid sequence comprising at least 192 contiguous nucleotides of SEQ ID NO: 37, or (g) a nucleic acid sequence comprising at least 84 contiguous nucleotides of SEQ ID NO: 38.

The adenovirus or adenoviral vector can comprise a nucleic acid sequence comprising at least 162 (e.g., 165 or more, 170 or more, 190 or more, 200 or more, 250 or more, or 300 or more) contiguous nucleotides of SEQ ID NO: 32, but no more than 399 (e.g., 398 or less, 350 or less, or 275 or less) contiguous nucleotides of SEQ ID NO: 32. Preferably, the adenovirus or adenoviral vector comprises a nucleic acid sequence comprising 162 to 300 contiguous nucleotides (e.g., 163, 175, 200, 250, or 275 contiguous nucleotides), or 162 to 200 contiguous nucleotides (e.g., 164, 166, 167, 168, 169, 171, 172, 173, 174, 176, 177, 178, 179, 180, 181, 182, 183, 184, 185, 186, 187, 188, 189, 191, 192, 193, 194, 195, 196, 197, 198, or 199 contiguous nucleotides) of SEQ ID NO: 32, or a range defined by any two of the foregoing values.

The adenovirus or adenoviral vector can comprise a nucleic acid sequence comprising at least 162 (e.g., 165 or more, 170 or more, 190 or more, 200 or more, 250 or more, or 300 or more) contiguous nucleotides of SEQ ID NO: 33, but no more than 399 (e.g., 398 or less, 350 or less, or 275 or less) contiguous nucleotides of SEQ ID NO: 33. Preferably, the adenovirus or adenoviral vector comprises a nucleic acid sequence comprising 162 to 300 contiguous nucleotides (e.g., 163, 175, 200, 250, or 275 contiguous nucleotides), or 162 to 200 contiguous nucleotides (e.g., 164, 166, 167, 168, 169, 171, 172, 173, 174, 176, 177, 178, 179, 180, 181, 182, 183, 184, 185, 186, 187, 188, 189, 191, 192, 193, 194, 195, 196, 197, 198, or 199 contiguous nucleotides) of SEQ ID NO: 33, or a range defined by any two of the foregoing values.

The adenovirus or adenoviral vector can comprise a nucleic acid sequence comprising at least 121 (e.g., 125 or more, 130 or more, 150 or more, 200 or more, 250 or more, or 300 or more) contiguous nucleotides of SEQ ID NO: 34, but no more than 399 (e.g., 398 or less, 350 or less, or 275 or less) contiguous nucleotides of SEQ ID NO: 34. Preferably, the adenovirus or adenoviral vector comprises a nucleic acid sequence comprising 121 to 300 contiguous nucleotides (e.g., 125, 150, 175, 200, 250, or 275 contiguous nucleotides), 121 to 200 contiguous nucleotides (e.g., 130, 140, 145, 160, 165, 170, 180, 185, 190, 195, or 199 contiguous nucleotides), or 121 to 150 contiguous nucleotides (e.g., 122, 123, 124, 125, 126, 127, 128, 129, 130, 131, 132, 133, 134, 135, 136, 137, 138, 139, 140, 141, 142, 143, 144, 145, 146, 147, 148, or 149 contiguous nucleotides) of SEQ ID NO: 34, or a range defined by any two of the foregoing values.

The adenovirus or adenoviral vector can comprise a nucleic acid sequence comprising at least 531 (e.g., 540 or more, 600 or more, 700 or more, 800 or more, 900 or more, or 1,000 or more) contiguous nucleotides of SEQ ID NO: 35, but no more than 3168 (e.g., 3,100 or less, 3,000 or less, 2,500 or less, 2,000 or less, or 1,500 or less) contiguous nucleotides of SEQ ID NO: 35. Preferably, the adenovirus or adenoviral vector comprises a nucleic acid sequence comprising 531 to 2,000 contiguous nucleotides (e.g., 550, 600, 700, 1,000, 1,200, 1,500, or 1,700 contiguous nucleotides), 531 to 1,000 contiguous nucleotides (e.g., 535, 575, 600, 650, 675, 725, 750, 800, 850, 900, or 950 contiguous nucleotides), or 531 to 800 contiguous nucleotides (e.g., 540, 545, 550, 560, 565, 570, 580, 585, 590, 595, 615, 625, 630, 640, 660, 665, 670, 680, 685, 690, 695, 705, 715, 730, 740, 755, 760, 765, 770, 775, 780, 785, 790, 795, or 799 contiguous nucleotides) of SEQ ID NO: 35, or a range defined by any two of the foregoing values.

The adenovirus or adenoviral vector can comprise a nucleic acid sequence comprising at least 156 (e.g., 160 or more, 200 or more, 225 or more, 235 or more, 250 or more, 300 or more, 350 or more, 400 or more, 450 or more, or 500 or more) contiguous nucleotides of SEQ ID NO: 36, but no more than 1,863 (e.g., 1,800 or less, 1,500 or less, 1,200 or less, 1,000 or less, 850 or less, 800 or less, 750 or less, or 700 or less) contiguous nucleotides of SEQ ID NO: 36. Preferably, the adenovirus or adenoviral vector comprises a nucleic acid sequence comprising 156 to 1,500 contiguous nucleotides (e.g., 175, 210, 225, 245, 255, 265, 275, 290, 300, 400, 500, 600, 700, 800, 900, 1,000, or 1,200 contiguous nucleotides), 156 to 1,000 contiguous nucleotides (e.g., 165, 180, 185, 195, 205, 230, 240, 260, 270, 295, 350, 450, 550, 650, 750, 850, or 950 contiguous nucleotides), or 156 to 500 contiguous nucleotides (e.g., 199, 230, 235, 290, 305, 310, 315, 325, 340, 345, 360, 365, 370, 375, 380, 385, 390, 395, 405, 425, 430, 440, 455, 460, 465, 470, 475, 480, 485, 490, 495, or 499 contiguous nucleotides) of SEQ ID NO: 36, or a range defined by any two of the foregoing values.

The adenovirus or adenoviral vector can comprise a nucleic acid sequence comprising at least 192 (e.g., 200 or more, 300 or more, 400 or more, 500 or more, or 600 or more) contiguous nucleotides of SEQ ID NO: 37, but no more than 2841 (2,800 or less, 2,500 or less, 2,000 or less, 1,800 or less, or 1,500 or less) contiguous nucleotides of SEQ ID NO: 37. Preferably, the adenovirus or adenoviral vector comprises a nucleic acid sequence comprising 192 to 2,000 contiguous nucleotides (e.g., 200, 250, 300, 350, 400, 450, 500, 550, 600, 650, 700, 800, 900, 1,000, 1,200, 1,500, 1,700, or 1,900 contiguous nucleotides), 192 to 1,000 contiguous nucleotides (e.g., 275, 375, 475, 575, 675, 775, 875, or 975 contiguous nucleotides), or 192 to 500 contiguous nucleotides (e.g., 220, 235, 240, 255, 260, 270, 280, 285, 290, 295, 299, 305, 315, 330, 335, 340, 345, 355, 360, 365, 370, 385, 390, 395, 399, 405, 415, 430, 435, 440, 445, 455, 460, 465, 470, 485, 490, 495, 499 contiguous nucleotides) of SEQ ID NO: 37, or a range defined by any two of the foregoing values.

The adenovirus or adenoviral vector can comprise a nucleic acid sequence comprising at least 84 (e.g., 90 or more, 100 or more, 200 or more, 300 or more, 500 or more, 700 or more, or 900 or more) contiguous nucleotides of SEQ ID NO: 38, but no more than 1,740 (1,700 or less, 1,500 or less, 1,200 or less, or 1,000 or less) contiguous nucleotides of SEQ ID NO: 38. Preferably, the adenovirus or adenoviral vector comprises a nucleic acid sequence comprising 84 to 1,200 contiguous nucleotides (e.g., 95, 100, 200, 400, 600, 800, 1,000, or 1,200 contiguous nucleotides), 84 to 1,000 contiguous nucleotides (e.g., 95, 150, 195, 250, 350, 450, 550, 650, 750, 850, or 950 contiguous nucleotides), or 84 to 500 contiguous nucleotides (e.g., 90, 99, 115, 125, 130, 145, 155, 165, 175, 190, 225, 230, 240, 255, 260, 265, 270, 275, 315, 325, 330, 340, 355, 360, 365, 370, 375, 380, 385, 390, 395, 415, 425, 430, 440, 455, 460, 465, 470, 475, 480, 485, 490, 495, or 499 contiguous nucleotides) of SEQ ID NO: 38, or a range defined by any two of the foregoing values.

The adenovirus or adenoviral vector can comprise one, two, three, four, five, six, or all seven of the aforementioned sequences alone, or in any combination. In this respect, the adenovirus or adenoviral vector can comprise any combination of any two of the aforementioned sequences, any combination of any three of the aforementioned sequences, any combination of any four of the aforementioned sequences, any combination of any five of the aforementioned sequences, any combination of any six of the aforementioned sequences, or all seven of the aforementioned sequences. For example, the adenovirus or adenoviral vector can comprise a nucleic acid sequence comprising at least 162 contiguous nucleotides of SEQ ID NO: 32. The adenovirus or adenoviral vector can comprise a nucleic acid sequence comprising at least 121 contiguous nucleotides of SEQ ID NO: 34, a nucleic acid sequence comprising at least 156 contiguous nucleotides of SEQ ID NO: 36, and a nucleic acid sequence comprising at least 84 contiguous nucleotides of SEQ ID NO: 38. The adenovirus or adenoviral vector can comprise a nucleic acid sequence comprising at least 162 contiguous nucleotides of SEQ ID NO: 33, a nucleic acid sequence comprising at least 531 contiguous nucleotides of SEQ ID NO: 35, and a nucleic acid sequence comprising at least 192 contiguous nucleotides of SEQ ID NO: 37. The adenovirus or adenoviral vector can comprise a nucleic acid sequence comprising at least 121 contiguous nucleotides of SEQ ID NO: 34, and a nucleic acid sequence comprising at least 531 contiguous nucleotides of SEQ ID NO: 35. The adenovirus or adenoviral vector can comprise (a) a nucleic acid sequence comprising at least 162 contiguous nucleotides of SEQ ID NO: 32 or SEQ ID NO: 33, (b) a nucleic acid sequence comprising at least 531 contiguous nucleotides of SEQ ID NO: 35, (c) a nucleic acid sequence comprising at least 156 contiguous nucleotides of SEQ ID NO: 36, (d) a nucleic acid sequence comprising at least 192 contiguous nucleotides of SEQ ID NO: 37, and (e) a nucleic acid sequence comprising at least 84 contiguous nucleotides of SEQ ID NO: 38.

In another embodiment, the adenovirus or adenoviral vector comprises one or more of the following amino acid sequences: (a) an amino acid sequence that is at least 85% identical (e.g., at least 91.67%, at least 98.33%, or 100% identical) to SEQ ID NO: 40, (b) an amino acid sequence that is at least 80% identical (e.g., at least 86.25%, at least 92.50%, at least 98.75%, or 100% identical) to SEQ ID NO: 41, and (c) an amino acid sequence that is at least 80% identical (e.g., at least 80.25%, at least 86.50%, at least 92.75%, at least 99.00%, or 100% identical) to SEQ ID NO: 42.

The adenovirus or adenoviral vector can comprise one, two, or all three of the aforementioned amino acid sequences alone or in any combination. In this respect, the adenovirus or adenoviral vector can comprise one of the aforementioned sequences, any combination of any two of the aforementioned sequences, or all three of the aforementioned sequences. For example, the adenovirus or adenoviral vector can comprise an amino acid sequence that is at least 85% identical to SEQ ID NO: 40. The adenovirus or adenoviral vector can comprise an amino acid sequence that is at least 85% identical to SEQ ID NO: 40, and an amino acid sequence that is at least 80% identical to SEQ ID NO: 41. The adenovirus or adenoviral vector can comprise (a) an amino acid sequence that is at least 85% identical to SEQ ID NO: 40, (b) an amino acid sequence that is at least 80% identical to SEQ ID NO: 41, and (c) an amino acid sequence that is at least 80% identical to SEQ ID NO: 42. The adenovirus or adenoviral vector can comprise (a) the amino acid sequence of SEQ ID NO: 40, (b) the amino acid sequence of SEQ ID NO: 41, or (c) the amino acid sequence of SEQ ID NO: 42. The adenovirus or adenoviral vector can comprise (a) the amino acid sequence of SEQ ID NO: 40, (b) the amino acid sequence of SEQ ID NO: 41, and (c) the amino acid sequence of SEQ ID NO: 42.

In another embodiment, the adenovirus or adenoviral vector comprises one or more of the following amino acid sequences: (a) an amino acid sequence that is at least 99% identical (e.g., at least 99% or 100% identical) to SEQ ID NO: 44, (b) an amino acid sequence that is at least 81.4% identical (e.g., at least 81.56%, at least 81.72%, at least 81.88%, at least 82.04%, at least 82.21%, at least 82.37%, at least 82.53%, at least 82.69%, at least 82.85%, at least 83.01%, at least 83.17%, at least 83.33%, at least 83.49%, at least 83.65%, at least 83.82%, at least 83.98%, at least 84.14%, at least 84.30%, at least 84.46%, at least 84.62%, at least 84.78%, at least 84.94%, at least 85.10%, at least 85.26%, at least 85.43%, at least 85.59%, at least 85.75%, at least 85.91%, at least 86.07%, at least 86.23%, at least 86.39%, at least 86.55%, at least 86.71%, at least 86.88%, at least 87.04%, at least 87.20%, at least 87.36%, at least 87.52%, at least 87.68%, at least 87.84%, at least 88.00%, at least 88.16%, at least 88.32%, at least 88.49%, at least 88.65%, at least 88.81%, at least 88.97%, at least 89.13%, at least 89.29%, at least 89.45%, at least 89.61%, at least 89.77%, at least 89.93%, at least 90.10%, at least 90.26%, at least 90.42%, at least 90.58%, at least 90.74%, at least 90.90%, at least 91.06%, at least 91.22%, at least 91.38%, at least 91.54%, at least 91.71%, at least 91.87%, at least 92.03%, at least 92.19%, at least 92.35%, at least 92.51%, at least 92.67%, at least 92.83%, at least 92.99%, at least 93.16%, at least 93.32%, at least 93.48%, at least 93.64%, at least 93.80%, at least 93.96%, at least 94.12%, at least 94.28%, at least 94.44%, at least 94.60%, at least 94.77%, at least 94.93%, at least 95.09%, at least 95.25%, at least 95.41%, at least 95.57%, at least 95.73%, at least 95.89%, at least 96.05%, at least 96.21%, at least 96.38%, at least 96.54%, at least 96.70%, at least 96.86%, at least 97.02%, at least 97.18%, at least 97.34%, at least 97.50%, at least 97.66%, at least 97.83%, at least 97.99%, at least 98.15%, at least 98.31%, at least 98.47%, at least 98.63%, at least 98.79%, at least 98.95%, at least 99.11%, at least 99.27%, at least 99.44%, at least 99.60%, at least 99.76%, at least 99.92%, or 100% identical to) to SEQ ID NO: 46, (c) an amino acid sequence that is at least 91.3% identical (e.g., at least 91.41%, at least 91.51%, at least 91.62%, at least 91.72%, at least 91.83%, at least 91.93%, at least 92.04%, at least 92.14%, at least 92.25%, at least 92.36%, at least 92.46%, at least 92.57%, at least 92.67%, at least 92.78%, at least 92.88%, at least 92.99%, at least 93.10%, at least 93.20%, at least 93.31%, at least 93.41%, at least 93.52%, at least 93.62%, at least 93.73%, at least 93.83%, at least 93.94%, at least 94.05%, at least 94.15%, at least 94.26%, at least 94.36%, at least 94.47%, at least 94.57%, at least 94.68%, at least 94.78%, at least 94.89%, at least 95.00%, at least 95.10%, at least 95.21%, at least 95.31%, at least 95.42%, at least 95.52%, at least 95.63%, at least 95.74%, at least 95.84%, at least 95.95%, at least 96.05%, at least 96.16%, at least 96.26%, at least 96.37%, at least 96.47%, at least 96.58%, at least 96.69%, at least 96.79%, at least 96.90%, at least 97.00%, at least 97.11%, at least 97.21%, at least 97.32%, at least 97.42%, at least 97.53%, at least 97.64%, at least 97.74%, at least 97.85%, at least 97.95%, at least 98.06%, at least 98.16%, at least 98.27%, at least 98.37%, at least 98.48%, at least 98.59%, at least 98.69%, at least 98.80%, at least 98.90%, at least 99.01%, at least 99.11%, at least 99.22%, at least 99.33%, at least 99.43%, at least 99.54%, at least 99.64%, at least 99.75%, at least 99.85%, at least 99.96%, or 100% identical) to SEQ ID NO: 47, and (d) an amino acid sequence that is at least 83.4% identical (e.g., at least 83.57%, at least 83.74%, at least 83.92%, at least 84.09%, at least 84.26%, at least 84.43%, at least 84.61%, at least 84.78%, at least 84.95%, at least 85.12%, at least 85.30%, at least 85.47%, at least 85.64%, at least 85.81%, at least 85.99%, at least 86.16%, at least 86.33%, at least 86.50%, at least 86.68%, at least 86.85%, at least 87.02%, at least 87.19%, at least 87.37%, at least 87.54%, at least 87.71%, at least 87.88%, at least 88.06%, at least 88.23%, at least 88.40%, at least 88.57%, at least 88.74%, at least 88.92%, at least 89.09%, at least 89.26%, at least 89.43%, at least 89.61%, at least 89.78%, at least 89.95%, at least 90.12%, at least 90.30%, at least 90.47%, at least 90.64%, at least 90.81%, at least 90.99%, at least 91.16%, at least 91.33%, at least 91.50%, at least 91.68%, at least 91.85%, at least 92.02%, at least 92.19%, at least 92.37%, at least 92.54%, at least 92.71%, at least 92.88%, at least 93.06%, at least 93.23%, at least 93.40%, at least 93.57%, at least 93.74%, at least 93.92%, at least 94.09%, at least 94.26%, at least 94.43%, at least 94.61%, at least 94.78%, at least 94.95%, at least 95.12%, at least 95.30%, at least 95.47%, at least 95.64%, at least 95.81%, at least 95.99%, at least 96.16%, 96.33%, at least 96.50%, at least 96.68%, at least 96.85%, at least 97.02%, at least 97.19%, at least 97.37%, at least 97.54%, at least 97.71%, at least 97.88%, at least 98.06%, at least 98.23%, at least 98.40%, at least 98.57%, at least 98.74%, at least 98.92%, at least 99.09%, at least 99.26%, at least 99.43%, at least 99.61%, at least 99.78%, at least 99.95%, or 100% identical) to SEQ ID NO: 48.

The adenovirus or adenoviral vector can comprise one, two, three, or all four of the aforementioned amino acid sequences alone or in any combination. In this respect, the adenovirus or adenoviral vector can comprise any combination of any two of the aforementioned sequences, any combination of any three of the aforementioned sequences, or all four of the aforementioned sequences. For example, the adenovirus or adenoviral vector can comprise an amino acid sequence that is at least 99% identical to SEQ ID NO: 44. The adenovirus or adenoviral vector can comprise an amino acid sequence that is at least 99% identical to SEQ ID NO: 44, and an amino acid sequence that is at least 91.3% identical to SEQ ID NO: 47. The adenovirus or adenoviral vector can comprise an amino acid sequence that is at least 99% identical to SEQ ID NO: 44, an amino acid sequence that is at least 81.4% identical to SEQ ID NO: 46, and an amino acid sequence that is at least 91.3% identical to SEQ ID NO: 47. The adenovirus or adenoviral vector can comprise (a) the amino acid sequence of SEQ ID NO: 44, (b) the amino acid sequence of SEQ ID NO: 46, (c) the amino acid sequence of SEQ ID NO: 47, or (d) the amino acid sequence of SEQ ID NO: 48. The adenovirus or adenoviral vector can comprise (a) an amino acid sequence that is at least 99% identical to SEQ ID NO: 44, (b) an amino acid sequence that is at least 81.4% identical to SEQ ID NO: 46, (c) an amino acid sequence that is at least 91.3% identical to SEQ ID NO: 47, and (d) an amino acid sequence that is at least 83.4% identical to SEQ ID NO: 48. The adenovirus or adenoviral vector can comprise (a) the amino acid sequence of SEQ ID NO: 44, (b) the amino acid sequence of SEQ ID NO: 46, (c) the amino acid sequence of SEQ ID NO: 47, and (d) the amino acid sequence of SEQ ID NO: 48.

In another embodiment, the adenovirus or adenoviral vector comprises one or more of the following amino acid sequences: (a) an amino acid sequence comprising at least 89 contiguous amino acid residues of SEQ ID NO: 44, (b) an amino acid sequence comprising at least 114 contiguous amino acid residues of SEQ ID NO: 46, (c) an amino acid sequence comprising at least 231 contiguous amino acid residues of SEQ ID NO: 47, and (d) an amino acid sequence comprising at least 30 contiguous amino acid residues of SEQ ID NO: 48.

The adenovirus or adenoviral vector can comprise an amino acid sequence comprising at least 89 (e.g., 90 or more, 100 or more, or 110 or more) contiguous amino acid residues of SEQ ID NO: 44, but no more than 133 (e.g., 130 or less, 125 or less, 120 or less, or 115 or less) contiguous amino acid residues of SEQ ID NO: 44. Preferably, the adenovirus or adenoviral vector comprises an amino acid sequence comprising 89 to 130 contiguous amino acid residues (e.g., 90, 100, 110, 115, 120, or 125 contiguous amino acid residues) of SEQ ID NO: 44, 89 to 115 contiguous amino acid residues of SEQ ID NO: 44 (e.g., 95, 110, or 112 contiguous amino acid residues), or 89 to 100 contiguous amino acid residues (e.g., 89, 90, 91, 92, 93, 94, 95, 96, 97, 98, or 99 contiguous amino acid residues) of SEQ ID NO: 44, or a range defined by any two of the foregoing values.

The adenovirus or adenoviral vector can comprise an amino acid sequence comprising at least 114 (e.g., 125 or more, 150 or more, 175 or more, 200 or more, 250 or more 250 or more, 275 or more, 300 or more, or 400 or more) contiguous amino acid residues of SEQ ID NO: 46, but no more than 621 (e.g., 620 or less, 600 or less, 550 or less, or 450 or less) contiguous amino acid residues of SEQ ID NO: 46. Preferably, the adenovirus or adenoviral vector comprises an acid sequence comprising 114 to 600 contiguous amino acid residues (e.g., 155, 180, 200, 250, 275, 300, 400, or 500 contiguous amino acid residues) of SEQ ID NO: 46, 114 to 500 contiguous amino acid residues of SEQ ID NO: 46 (e.g., 130, 160, 190, 220, 250, 280, 310, 340, 370, 375, 400, 425, 450, or 475 contiguous amino acid residues), or 114 to 300 contiguous amino acid residues (e.g., 165, 175, 185, 195, 199, 15, 225, 235, 245, 255, 265, 285, 295, 299, 315, 325, 335, 345, 355, 360, 365, 380, 385, 390, 395, or 399 contiguous amino acid residues) of SEQ ID NO: 46, or a range defined by any two of the foregoing values.

The adenovirus or adenoviral vector can comprise an amino acid sequence comprising at least 231 (e.g., 250 or more, 300 or more, 400 or more, or 500 or more) contiguous amino acid residues of SEQ ID NO: 47, but no more than 947 (e.g., 940 or less, 900 or less, 800 or less, 700 or less, or 600 or less) contiguous amino acid residues of SEQ ID NO: 47. Preferably, the adenovirus or adenoviral vector comprises an acid sequence comprising 231 to 800 contiguous amino acid residues (e.g., 250, 275, 290, 325, 350, 375, 390, 400, 500, 600, or 700 contiguous amino acid residues) of SEQ ID NO: 47, 231 to 600 contiguous amino acid residues (e.g., 235, 260, 285, 300, 335, 360, 375, 385, 395, 425, 445, 450, 465, 475, 525, 545, 550, 565 or 575 contiguous amino acid residues) of SEQ ID NO: 47, or 231 to 400 contiguous amino acid residues (e.g., 245, 255, 265, 285, 295, 299, 315, 345, 355, 365, 385, 389, 395, or 399 contiguous amino acid residues) of SEQ ID NO: 47, or a range defined by any two of the foregoing values.

The adenovirus or adenoviral vector can comprise an amino acid sequence comprising at least 30 (e.g., 50 or more, 75 or more, 100 or more, 200 or more, or 300 or more) contiguous amino acid residues of SEQ ID NO: 48, but no more than 580 (e.g., 575 or less, 550 or less, 500 or less, 450 or less, or 400 or less) contiguous amino acid residues of SEQ ID NO: 48. Preferably, the adenovirus or adenoviral vector comprises an acid sequence comprising 30 to 500 contiguous amino acid residues (e.g., 35, 55, 85, 105, 135, 155, 175, 195, 200, 205, 235, 250, 275, 295, 300, 305, 335, 350, 375, 395, 400, 405, 435, 450, 475, 495, or 499 contiguous amino acid residues) of SEQ ID NO: 48, 30 to 300 contiguous amino acid residues (e.g., 40, 60, 70, 90, 125, 140, 160, 170, 180, 190, 200, 210, 220, 230, 240, 250, 260, 270, 280, or 290 contiguous amino acid residues) of SEQ ID NO: 48, or 30 to 100 contiguous amino acid residues (e.g., 33, 34, 39, 42, 43, 44, 49, 52, 58, 59, 62, 68, 69, 72, 78, 79, 81, 84, 87, 88, 91, 92, 93, 94, 97, 98, or 99 contiguous amino acid residues) of SEQ ID NO: 48, or a range defined by any two of the foregoing values.

The adenovirus or adenoviral vector can comprise one, two, three, or all four of the aforementioned amino acid sequences alone or in any combination. In this respect, the adenovirus or adenoviral vector can comprise any combination of any two of the aforementioned sequences, any combination of any three of the aforementioned sequences, or all four of the aforementioned sequences. For example, the adenovirus or adenoviral vector can comprise an amino acid sequence comprising at least 89 contiguous amino acid residues of SEQ ID NO: 44. The adenovirus or adenoviral vector can comprise an amino acid sequence comprising at least 89 contiguous amino acid residues of SEQ ID NO: 44, and an amino acid sequence comprising at least 114 contiguous amino acid residues of SEQ ID NO: 46. The adenovirus or adenoviral vector can comprise (a) an amino acid sequence comprising at least 89 contiguous amino acid residues of SEQ ID NO: 44, (b) an amino acid sequence comprising at least 231 contiguous amino acid residues of SEQ ID NO: 47, and (c) an amino acid sequence comprising at least 30 contiguous amino acid residues of SEQ ID NO: 48. The adenovirus or adenoviral vector can comprise (a) an amino acid sequence comprising at least 114 contiguous amino acid residues of SEQ ID NO: 46, (b) an amino acid sequence comprising at least 231 contiguous amino acid residues of SEQ ID NO: 47, and (c) an amino acid sequence comprising at least 30 contiguous amino acid residues of SEQ ID NO: 48. The adenovirus or adenoviral vector can comprise (a) an amino acid sequence comprising at least 89 contiguous amino acid residues of SEQ ID NO: 44, (b) an amino acid sequence comprising at least 114 contiguous amino acid residues of SEQ ID NO: 46, (c) an amino acid sequence comprising at least 231 contiguous amino acid residues of SEQ ID NO: 47, and (d) an amino acid sequence comprising at least 30 contiguous amino acid residues of SEQ ID NO: 48.

In other embodiments, the adenovirus or adenoviral vector comprises one or more nucleic acid sequences that encode one or more of any of the aforementioned amino acid sequences, e.g., the amino acid sequences of any of SEQ ID NOs: 39-48 or any of the variants and/or portions thereof as described herein. For example, the adenovirus or adenoviral vector can comprise a nucleic acid sequence encoding an amino acid sequence that is at least 99.75% identical (e.g., at least 99.84%, at least 99.94%, or 100% identical) to SEQ ID NO: 45, or a nucleic acid sequence encoding an amino acid sequence that is at least 99.7% identical (e.g., at least 99.93% or 100% identical) to SEQ ID NO: 39.

In one embodiment, the adenovirus or adenoviral vector comprises one or more of the following nucleic acid sequences: (a) a nucleic acid sequence that is at least 97% identical (e.g., at least 98.20%, at least 99.41%, or 100% identical) to SEQ ID NO: 63, (b) a nucleic acid sequence that is at least 97.5% identical (e.g., at least 98.5%, at least 99.5%, or 100% identical) to SEQ ID NO: 64, (c) a nucleic acid sequence that is at least 80% identical (e.g., at least 82.22%, at least 84.44%, at least 86.67%, at least 88.89%, at least 91.11%, at least 93.33%, at least 95.56%, at least 97.78%, or 100% identical) to SEQ ID NO: 65, (d) a nucleic acid sequence that is at least 96% identical (e.g., at least 96.9%, at least 97.8%, at least 98.7%, at least 99.6%, or 100% identical) to SEQ ID NO: 66, and (e) a nucleic acid sequence that is at least 96% identical (e.g., at least 96.83% or 100% identical) to SEQ ID NO: 67.

The adenovirus or adenoviral vector can comprise one, two, three, four, or all five of the aforementioned sequences alone or in any combination. In this respect, the adenovirus or adenoviral vector can comprise any combination of any two of the aforementioned sequences, any combination of any three of the aforementioned sequences, any combination of any four of the aforementioned sequences, or all five of the aforementioned sequences. For example, the adenovirus or adenoviral vector can comprise a nucleic acid sequence that is at least 97% identical to SEQ ID NO: 63. The adenovirus or adenoviral vector can comprise a nucleic acid sequence that is at least 97.5% identical to SEQ ID NO: 64 and a nucleic acid sequence that is at least 80% identical to SEQ ID NO: 65. The adenovirus or adenoviral vector can comprise a nucleic acid sequence that is at least 97% identical to SEQ ID NO: 63, a nucleic acid sequence that is at least 80% identical to SEQ ID NO: 65, and a nucleic acid sequence that is at least 96% identical to SEQ ID NO: 67. The adenovirus or adenoviral vector can comprise (a) the nucleic acid sequence of SEQ ID NO: 63, (b) the nucleic acid sequence SEQ ID NO: 64, (c) the nucleic acid sequence of SEQ ID NO: 65, (d) the nucleic acid sequence of SEQ ID NO: 66, or (e) the nucleic acid sequence of SEQ ID NO: 67. The adenovirus or adenoviral vector can comprise (a) a nucleic acid sequence that is at least 97% identical to SEQ ID NO: 63, (b) a nucleic acid sequence that is at least 97.5% identical to SEQ ID NO: 64, (c) a nucleic acid sequence that is at least 80% identical to SEQ ID NO: 65, (d) a nucleic acid sequence that is at least 96% identical to SEQ ID NO: 66, and (e) a nucleic acid sequence that is at least 96% identical to SEQ ID NO: 67. The adenovirus or adenoviral vector can comprise (a) the nucleic acid sequence of SEQ ID NO: 63, (b) the nucleic acid sequence SEQ ID NO: 64, (c) the nucleic acid sequence of SEQ ID NO: 65, (d) the nucleic acid sequence of SEQ ID NO: 66, and (e) the nucleic acid sequence of SEQ ID NO: 67.

In another embodiment, the adenovirus or adenoviral vector comprises one or more of the following nucleic acid sequences: (a) a nucleic acid sequence that is at least 98.4% identical (e.g., at least 98.65%, at least 98.9%, at least 99.15%, at least 99.4%, at least 99.65%, at least 99.9%, or 100% identical) to SEQ ID NO: 68, (b) a nucleic acid sequence that is at least 99.01% identical (e.g., at least 99.04%, at least 99.07%, at least 99.10%, at least 99.14%, at least 99.17%, at least 99.20%, at least 99.23%, at least 99.26%, at least 99.29%, at least 99.33%, at least 99.36%, at least 99.39%, at least 99.42%, at least 99.45%, at least 99.48%, at least 99.52%, at least 99.55%, at least 99.58%, at least 99.61%, at least 99.64%, at least 99.67%, at least 99.70%, at least 99.74%, at least 99.77%, at least 99.80%, at least 99.83%, at least 99.86%, at least 99.89%, at least 99.93%, at least 99.96%, at least 99.99%, or 100% identical) to SEQ ID NO: 69, (c) a nucleic acid sequence that is at least 97.08% identical (e.g., at least 97.13%, at least 97.18%, at least 97.23%, at least 97.28%, at least 97.33%, at least 97.38%, at least 97.43%, at least 97.49%, at least 97.54%, at least 97.59%, at least 97.64%, at least 97.69%, at least 97.74%, at least 97.79%, at least 97.84%, at least 97.89%, at least 97.94%, at least 97.99%, at least 98.04%, at least 98.09%, at least 98.14%, at least 98.19%, at least 98.25%, at least 98.30%, at least 98.35%, at least 98.40%, at least 98.45%, at least 98.50%, at least 98.55%, at least 98.60%, at least 98.65%, at least 98.70%, at least 98.75%, at least 98.80%, at least 98.85%, at least 98.90%, at least 98.95%, at least 99.01%, at least 99.06%, at least 99.11%, at least 99.16%, at least 99.21%, at least 99.26%, at least 99.31%, at least 99.36%, at least 99.41%, at least 99.46%, at least 99.5%1, at least 99.56%, at least 99.61%, at least 99.66%, at least 99.71%, at least 99.76%, at least 99.82%, at least 99.87%, at least 99.92%, at least 99.97%, or 100% identical) to SEQ ID NO: 70, (d) a nucleic acid sequence that is at least 96.52% identical (e.g., at least 96.55%, at least 96.59%, at least 96.62%, at least 96.66%, at least 96.69%, at least 96.73%, at least 96.76%, at least 96.80%, at least 96.83%, at least 96.87%, at least 96.90%, at least 96.94%, at least 96.97%, at least 97.01%, at least 97.04%, at least 97.08%, at least 97.11%, at least 97.15%, at least 97.18%, at least 97.22%, at least 97.25%, at least 97.29%, at least 97.32%, at least 97.36%, at least 97.39%, at least 97.43%, at least 97.46%, at least 97.50%, at least 97.53%, at least 97.57%, at least 97.60%, at least 97.64%, at least 97.67%, at least 97.71%, at least 97.74%, at least 97.78%, at least 97.81%, at least 97.85%, at least 97.88%, at least 97.92%, at least 97.95%, at least 97.99%, at least 98.02%, at least 98.06%, at least 98.09%, at least 98.13%, at least 98.16%, at least at least 98.20%, at least 98.23%, at least 98.27%, at least 98.30%, at least 98.34%, at least 98.37%, at least at least 98.40%, at least 98.44%, at least 98.47%, at least 98.51%, at least 98.54%, at least 98.58%, at least 98.61%, at least 98.65%, at least 98.68%, at least 98.72%, at least 98.75%, at least 98.79%, at least 98.82%, at least 98.86%, at least 98.89%, at least 98.93%, at least 98.96%, at least 99.00%, at least 99.03%, at least 99.07%, at least 99.10%, at least 99.14%, at least 99.17%, at least 99.21%, at least 99.24%, at least 99.28%, at least 99.31%, at least 99.35%, at least 99.38%, at least 99.42%, at least 99.45%, at least 99.49%, at least 99.52%, at least 99.56%, at least 99.59%, at least 99.63%, at least 99.66%, at least 99.70%, at least 99.73%, at least 99.77%, at least 99.80%, at least 99.84%, at least 99.87%, at least 99.91%, at least 99.94%, at least 99.98%, or 100% identical) to SEQ ID NO: 71, and (e) a nucleic acid sequence that is at least 98.49% identical (e.g., at least 98.55%, at least 98.60%, at least 98.66%, at least 98.72%, at least 98.78%, at least 98.83%, at least 98.89%, at least 98.95%, at least 99.01%, at least 99.06%, at least 99.12%, at least 99.18%, at least 99.24%, at least 99.29%, at least 99.35%, at least 99.41%, at least 99.47%, at least 99.52%, at least 99.58%, at least 99.64%, at least 99.70%, at least 99.75%, at least 99.81%, at least 99.87%, at least 99.93%, at least 99.98%, or 100% identical) to SEQ ID NO: 72.

The adenovirus or adenoviral vector can comprise one, two, three, four, or all five of the aforementioned sequences alone or in any combination. In this respect, the adenovirus or adenoviral vector can comprise any combination of any two of the aforementioned sequences, any combination of any three of the aforementioned sequences, any combination of any four of the aforementioned sequences, or all five of the aforementioned sequences. For example, the adenovirus or adenoviral vector can comprise a nucleic acid sequence that is at least 98.4% identical to SEQ ID NO: 68. The adenovirus or adenoviral vector can comprise a nucleic acid sequence that is at least 99.01% identical to SEQ ID NO: 69 and a nucleic acid sequence that is at least 97.08% identical to SEQ ID NO: 70. The adenovirus or adenoviral vector can comprise a nucleic acid sequence that is at least 97.08% identical to SEQ ID NO: 70, a nucleic acid sequence that is at least 96.52% identical to SEQ ID NO: 71, and a nucleic acid sequence that is at least 98.49% identical to SEQ ID NO: 72. The adenovirus or adenoviral vector can comprise (a) the nucleic acid sequence of SEQ ID NO: 68, (b) the nucleic acid sequence SEQ ID NO: 69, (c) the nucleic acid sequence of SEQ ID NO: 70, (d) the nucleic acid sequence of SEQ ID NO: 71, or (e) the nucleic acid sequence of SEQ ID NO: 72. The adenovirus or adenoviral vector can comprise (a) a nucleic acid sequence that is at least 98.4% identical to SEQ ID NO: 68, (b) a nucleic acid sequence that is at least 99.01% identical to SEQ ID NO: 69, (c) a nucleic acid sequence that is at least 97.08% identical to SEQ ID NO: 70, (d) a nucleic acid sequence that is at least 96.52% identical to SEQ ID NO: 71, and (e) a nucleic acid sequence that is at least 98.49% identical to SEQ ID NO: 72. The adenovirus or adenoviral vector can comprise (a) the nucleic acid sequence of SEQ ID NO: 68, (b) the nucleic acid sequence SEQ ID NO: 69, (c) the nucleic acid sequence of SEQ ID NO: 70, (d) the nucleic acid sequence of SEQ ID NO: 71, and (e) the nucleic acid sequence of SEQ ID NO: 72.

In another embodiment, the adenovirus or adenoviral vector comprises one or more of the following nucleic acid sequences: (a) a nucleic acid sequence comprising at least 121 contiguous nucleotides of SEQ ID NO: 68, (b) a nucleic acid sequence comprising at least 462 contiguous nucleotides of SEQ ID NO: 69, (c) a nucleic acid sequence comprising at least 234 contiguous nucleotides of SEQ ID NO: 70, (d) a nucleic acid sequence comprising at least 606 contiguous nucleotides of SEQ ID NO: 71, or (e) a nucleic acid sequence comprising at least 188 contiguous nucleotides of SEQ ID NO: 72.

The adenovirus or adenoviral vector can comprise a nucleic acid sequence comprising at least 121 (e.g., 125 or more, 130 or more, 150 or more, 200 or more, 250 or more, or 300 or more) contiguous nucleotides of SEQ ID NO: 68, but no more than 399 (e.g., 398 or less, 350 or less, or 275 or less) contiguous nucleotides of SEQ ID NO: 68. Preferably, the adenovirus or adenoviral vector comprises a nucleic acid sequence comprising 121 to 300 contiguous nucleotides (e.g., 125, 150, 175, 200, 250, or 275 contiguous nucleotides), 121 to 200 contiguous nucleotides (e.g., 130, 140, 145, 160, 165, 170, 180, 185, 190, 195, or 199 contiguous nucleotides), or 121 to 150 contiguous nucleotides (e.g., 122, 123, 124, 125, 126, 127, 128, 129, 130, 131, 132, 133, 134, 135, 136, 137, 138, 139, 140, 141, 142, 143, 144, 145, 146, 147, 148, or 149 contiguous nucleotides) of SEQ ID NO: 68, or a range defined by any two of the foregoing values.

The adenovirus or adenoviral vector can comprise a nucleic acid sequence comprising at least 462 (e.g., 470 or more, 500 or more, 600 or more, 700 or more, 800 or more, 900 or more, or 1,000 or more) contiguous nucleotides of SEQ ID NO: 69, but no more than 3168 (e.g., 3,100 or less, 3,000 or less, 2,500 or less, 2,000 or less, or 1,500 or less) contiguous nucleotides of SEQ ID NO: 69. Preferably, the adenovirus or adenoviral vector comprises a nucleic acid sequence comprising 462 to 2,000 contiguous nucleotides (e.g., 475, 500, 700, 1,000, 1,200, 1,500, or 1,700 contiguous nucleotides), 462 to 1,000 contiguous nucleotides (e.g., 490, 525, 575, 600, 650, 675, 725, 750, 800, 850, 900, or 950 contiguous nucleotides), or 462 to 800 contiguous nucleotides (e.g., 480, 485, 490, 495, 499, 510, 515, 530, 540, 550, 560, 565, 570, 580, 585, 590, 595, 615, 625, 630, 640, 660, 665, 670, 680, 685, 690, 695, 705, 715, 730, 740, 755, 760, 765, 770, 775, 780, 785, 790, 795, or 799 contiguous nucleotides) of SEQ ID NO: 69, or a range defined by any two of the foregoing values.

The adenovirus or adenoviral vector can comprise a nucleic acid sequence comprising at least 234 (e.g., 235 or more, 250 or more, 300 or more, 350 or more, 400 or more, 450 or more, or 500 or more) contiguous nucleotides of SEQ ID NO: 70, but no more than 1,974 (e.g., 1,900 or less, 1,800 or less, 1,500 or less, 1,200 or less, 1,000 or less, 850 or less, 800 or less, 750 or less, or 700 or less) contiguous nucleotides of SEQ ID NO: 70. Preferably, the adenovirus or adenoviral vector comprises a nucleic acid sequence comprising 234 to 1,500 contiguous nucleotides (e.g., 290, 300, 400, 500, 600, 700, 800, 900, 1,000, or 1,200 contiguous nucleotides), 234 to 1,000 contiguous nucleotides (e.g., 295, 350, 450, 550, 650, 750, 850, or 950 contiguous nucleotides), or 234 to 500 contiguous nucleotides (e.g., 290, 305, 310, 315, 325, 340, 345, 360, 365, 370, 375, 380, 385, 390, 395, 405, 425, 430, 440, 455, 460, 465, 470, 475, 480, 485, 490, 495, or 499 contiguous nucleotides) of SEQ ID NO: 70, or a range defined by any two of the foregoing values.

The adenovirus or adenoviral vector can comprise a nucleic acid sequence comprising at least 606 (e.g., 610 or more, 650 or more, 700 or more, 800 or more, or 1,000 or more) contiguous nucleotides of SEQ ID NO: 71, but no more than 2865 (2,800 or less, 2,500 or less, 2,000 or less, 1,800 or less, or 1,500 or less) contiguous nucleotides of SEQ ID NO: 71. Preferably, the adenovirus or adenoviral vector comprises a nucleic acid sequence comprising 606 to 2,000 contiguous nucleotides (e.g., 615, 650, 700, 800, 900, 1,000, 1,200, 1,500, 1,700, or 1,900 contiguous nucleotides), 606 to 1,000 contiguous nucleotides (e.g., 630, 645, 665, 675, 725, 750, 775, 825, 850, 875, 925, 950, or 975 contiguous nucleotides), or 606 to 800 contiguous nucleotides (e.g., 620, 635, 640, 655, 660, 670, 680, 685, 690, 695, 699, 705, 715, 730, 735, 740, 745, 755, 760, 765, 770, 785, 790, 795, or 799 contiguous nucleotides) of SEQ ID NO: 71, or a range defined by any two of the foregoing values.

The adenovirus or adenoviral vector can comprise a nucleic acid sequence comprising at least 188 (e.g., 189 or more, 200 or more, 300 or more, 500 or more, 700 or more, or 900 or more) contiguous nucleotides of SEQ ID NO: 72, but no more than 1,740 (1,700 or less, 1,500 or less, 1,200 or less, or 1,000 or less) contiguous nucleotides of SEQ ID NO: 72. Preferably, the adenovirus or adenoviral vector comprises a nucleic acid sequence comprising 188 to 1,500 contiguous nucleotides (e.g., 200, 400, 600, 800, 1,000, 1,200, or 1,400 contiguous nucleotides), 188 to 1,000 contiguous nucleotides (e.g., 195, 250, 350, 450, 550, 650, 750, 850, or 950 contiguous nucleotides), or 188 to 500 contiguous nucleotides (e.g., 190, 225, 230, 240, 255, 260, 265, 270, 275, 315, 325, 330, 340, 355, 360, 365, 370, 375, 380, 385, 390, 395, 415, 425, 430, 440, 455, 460, 465, 470, 475, 480, 485, 490, 495, or 499 contiguous nucleotides) of SEQ ID NO: 72, or a range defined by any two of the foregoing values.

The adenovirus or adenoviral vector can comprise one, two, three, four, or all five of the aforementioned sequences alone, or in any combination. In this respect, the adenovirus or adenoviral vector can comprise any combination of any two of the aforementioned sequences, any combination of any three of the aforementioned sequences, any combination of any four of the aforementioned sequences, or all five of the aforementioned sequences. For example, the adenovirus or adenoviral vector can comprise a nucleic acid sequence comprising at least 121 contiguous nucleotides of SEQ ID NO: 68. The adenovirus or adenoviral vector can comprise a nucleic acid sequence comprising at least 234 contiguous nucleotides of SEQ ID NO: 70, and a nucleic acid sequence comprising at least 188 contiguous nucleotides of SEQ ID NO: 72. The adenovirus or adenoviral vector can comprise a nucleic acid sequence comprising at least 462 contiguous nucleotides of SEQ ID NO: 69, a nucleic acid sequence comprising at least 606 contiguous nucleotides of SEQ ID NO: 71, and a nucleic acid sequence comprising at least 188 contiguous nucleotides of SEQ ID NO: 72. The adenovirus or adenoviral vector can comprise a nucleic acid sequence comprising at least 121 contiguous nucleotides of SEQ ID NO: 68, a nucleic acid sequence comprising at least 462 contiguous nucleotides of SEQ ID NO: 69, a nucleic acid sequence comprising at least 234 contiguous nucleotides of SEQ ID NO: 70, and a nucleic acid sequence comprising at least 606 contiguous nucleotides of SEQ ID NO: 71. The adenovirus or adenoviral vector can comprise (a) a nucleic acid sequence comprising at least 121 contiguous nucleotides of SEQ ID NO: 68, (b) a nucleic acid sequence comprising at least 462 contiguous nucleotides of SEQ ID NO: 69, (c) a nucleic acid sequence comprising at least 234 contiguous nucleotides of SEQ ID NO: 70, (d) a nucleic acid sequence comprising at least 606 contiguous nucleotides of SEQ ID NO: 71, and (e) a nucleic acid sequence comprising at least 188 contiguous nucleotides of SEQ ID NO: 72.

In another embodiment, the adenovirus or adenoviral vector comprises one or more of the following amino acid sequences: (a) an amino acid sequence that is at least 93% identical (e.g., at least 96.57% or 100% identical) to SEQ ID NO: 73, (b) an amino acid sequence that is at least 80% identical (e.g., at least 86.67%, at least 93.33%, or 100% identical) to SEQ ID NO: 75, (c) an amino acid sequence that is at least 92% identical (e.g., at least 97.56% or 100% identical) to SEQ ID NO: 76, and (d) an amino acid sequence that is at least 88% identical (e.g., at least 94.67% or 100% identical) to SEQ ID NO: 77.

The adenovirus or adenoviral vector can comprise one, two, three, or all four of the aforementioned amino acid sequences alone or in any combination. In this respect, the adenovirus or adenoviral vector can comprise any combination of any two of the aforementioned sequences, any combination of any three of the aforementioned sequences, or all four of the aforementioned sequences. For example, the adenovirus or adenoviral vector can comprise an amino acid sequence that is at least 93% identical to SEQ ID NO: 73. The adenovirus or adenoviral vector can comprise an amino acid sequence that is at least 93% identical to SEQ ID NO: 73, and an amino acid sequence that is at least 80% identical to SEQ ID NO: 75. The adenovirus or adenoviral vector can comprise an amino acid sequence that is at least 93% identical to SEQ ID NO: 73, an amino acid sequence that is at least 80% identical to SEQ ID NO: 75, and an amino acid sequence that is at least 88% identical to SEQ ID NO: 77. The adenovirus or adenoviral vector can comprise (a) the amino acid sequence of SEQ ID NO: 73, (b) the amino acid sequence of SEQ ID NO: 75, (c) the amino acid sequence of SEQ ID NO: 76, or (d) the amino acid sequence of SEQ ID NO: 77. The adenovirus or adenoviral vector can comprise (a) an amino acid sequence that is at least 93% identical to SEQ ID NO: 73, (b) an amino acid sequence that is at least 80% identical to SEQ ID NO: 75, (c) an amino acid sequence that is at least 92% identical to SEQ ID NO: 76, and (d) an amino acid sequence that is at least 88% identical to SEQ ID NO: 77. The adenovirus or adenoviral vector can comprise (a) the amino acid sequence of SEQ ID NO: 73, (b) the amino acid sequence of SEQ ID NO: 75, (c) the amino acid sequence of SEQ ID NO: 76, and (d) the amino acid sequence of SEQ ID NO: 77.

In another embodiment, the adenovirus or adenoviral vector comprises one or more of the following amino acid sequences: (a) an amino acid sequence that is at least 99% identical (e.g., at least 99.75% or 100% identical) to SEQ ID NO: 78, (b) an amino acid sequence that is at least 97.8% identical (e.g., at least 97.95%, at least 98.10%, at least 98.26%, at least 98.41%, at least 98.56%, at least 98.71%, at least 98.86%, at least 99.02%, at least 99.17%, at least 99.32%, at least 99.47%, at least 99.62%, at least 99.78%, at least 99.93%, or 100% identical) to SEQ ID NO: 80, (c) an amino acid sequence that is at least 99.1% identical (e.g., at least 99.20%, at least 99.31%, at least 99.41%, at least 99.52%, at least 99.62%, at least 99.73%, at least 99.83%, at least 99.94%, or 100% identical) to SEQ ID NO: 81, and (d) an amino acid sequence that is at least 99.2% identical (e.g., at least 99.37%, at least 99.54%, at least 99.72%, at least 99.89%, or 100% identical) to SEQ ID NO: 82.

The adenovirus or adenoviral vector can comprise one, two, three, or all four of the aforementioned amino acid sequences alone or in any combination. In this respect, the adenovirus or adenoviral vector can comprise any combination of any two of the aforementioned sequences, any combination of any three of the aforementioned sequences, or all four of the aforementioned sequences. For example, the adenovirus or adenoviral vector can comprise an amino acid sequence that is at least 99% identical to SEQ ID NO: 78. The adenovirus or adenoviral vector can comprise an amino acid sequence that is at least 99% identical to SEQ ID NO: 78, and an amino acid sequence that is at least 99.1% identical to SEQ ID NO: 81. The adenovirus or adenoviral vector can comprise an amino acid sequence that is at least 99% identical to SEQ ID NO: 78, an amino acid sequence that is at least 99.1% identical to SEQ ID NO: 81, and an amino acid sequence that is at least 99.2% identical to SEQ ID NO: 82. The adenovirus or adenoviral vector can comprise (a) the amino acid sequence of SEQ ID NO: 78, (b) the amino acid sequence of SEQ ID NO: 80, (c) the amino acid sequence of SEQ ID NO: 81, or (d) the amino acid sequence of SEQ ID NO: 82. The adenovirus or adenoviral vector can comprise (a) an amino acid sequence that is at least 99% identical to SEQ ID NO: 78, (b) an amino acid sequence that is at least 97.8% identical to SEQ ID NO: 80, (c) an amino acid that is at least 99.1% identical to SEQ ID NO: 81, and (d) an amino acid sequence that is at least 99.2% identical to SEQ ID NO: 82. The adenovirus or adenoviral vector can comprise (a) the amino acid sequence of SEQ ID NO: 78, (b) the amino acid sequence of SEQ ID NO: 80, (c) the amino acid sequence of SEQ ID NO: 81, and (d) the amino acid sequence of SEQ ID NO: 82.

In another embodiment, the adenovirus or adenoviral vector comprises one or more of the following amino acid sequences: (a) an amino acid sequence comprising at least 89 contiguous amino acid residues of SEQ ID NO: 78, (b) an amino acid sequence comprising at least 247 contiguous amino acid residues of SEQ ID NO: 80, (c) an amino acid sequence comprising at least 230 contiguous amino acid residues of SEQ ID NO: 81, and (d) an amino acid sequence comprising at least 231 contiguous amino acid residues of SEQ ID NO: 82.

The adenovirus or adenoviral vector can comprise an amino acid sequence comprising at least 89 (e.g., 90 or more, 100 or more, or 110 or more) contiguous amino acid residues of SEQ ID NO: 78, but no more than 133 (e.g., 130 or less, 125 or less, 120 or less, or 115 or less) contiguous amino acid residues of SEQ ID NO: 78. Preferably, the adenovirus or adenoviral vector comprises an amino acid sequence comprising 89 to 130 contiguous amino acid residues (e.g., 90, 100, 110, 115, 120, or 125 contiguous amino acid residues) of SEQ ID NO: 16, 89 to 115 contiguous amino acid residues of SEQ ID NO: 78 (e.g., 95, 110, or 112 contiguous amino acid residues), or 89 to 100 contiguous amino acid residues (e.g., 89, 90, 91, 92, 93, 94, 95, 96, 97, 98, or 99 contiguous amino acid residues) of SEQ ID NO: 78, or a range defined by any two of the foregoing values.

The adenovirus or adenoviral vector can comprise an amino acid sequence comprising at least 247 (e.g., 250 or more, 275 or more, 300 or more, or 400 or more) contiguous amino acid residues of SEQ ID NO: 80, but no more than 658 (e.g., 650 or less, 550 or less, or 450 or less) contiguous amino acid residues of SEQ ID NO: 80. Preferably, the adenovirus or adenoviral vector comprises an acid sequence comprising 247 to 600 contiguous amino acid residues (e.g., 255, 275, 300, 400, or 500 contiguous amino acid residues) of SEQ ID NO: 80, 247 to 500 contiguous amino acid residues of SEQ ID NO: 80 (e.g., 325, 350, 375, 425, 450, or 475 contiguous amino acid residues), or 247 to 400 contiguous amino acid residues (e.g., 265, 280, 285, 290, 295, 360, 365, 380, 385, 390, 395, or 399 contiguous amino acid residues) of SEQ ID NO: 80, or a range defined by any two of the foregoing values.

The adenovirus or adenoviral vector can comprise an amino acid sequence comprising at least 230 (e.g., 250 or more, 300 or more, 350 or more, 400 or more, or 500 or more) contiguous amino acid residues of SEQ ID NO: 81, but no more than 955 (e.g., 950 or less, 900 or less, 800 or less, 700 or less, or 600 or less) contiguous amino acid residues of SEQ ID NO: 81. Preferably, the adenovirus or adenoviral vector comprises an acid sequence comprising 230 to 800 contiguous amino acid residues (e.g., 240, 260, 270, 280, 290, 300, 350, 390, 400, 500, 600, or 750 contiguous amino acid residues) of SEQ ID NO: 81, 230 to 600 contiguous amino acid residues (e.g., 255, 265, 275, 285, 295, 305, 325, 335, 345, 355, 365, 375, 385, 395, 425, 445, 450, 465, 475, 525, 545, 550, 565 or 575 contiguous amino acid residues) of SEQ ID NO: 81, or 230 to 500 contiguous amino acid residues (e.g., 235, 245, 299, 320, 330, 340, 360, 370, 385, 389, 395, 399, 415, 435, 440, 460, 470, 480, or 499 contiguous amino acid residues) of SEQ ID NO: 81, or a range defined by any two of the foregoing values.

The adenovirus or adenoviral vector can comprise an amino acid sequence comprising at least 231 (e.g., 250 or more, 300 or more, or 350 or more) contiguous amino acid residues of SEQ ID NO: 82, but no more than 580 (e.g., 575 or less, 550 or less, 500 or less, 450 or less, or 400 or less) contiguous amino acid residues of SEQ ID NO: 82. Preferably, the adenovirus or adenoviral vector comprises an acid sequence comprising 231 to 500 contiguous amino acid residues (e.g., 245, 255, 275, 300, 350, 375, or 400 contiguous amino acid residues) of SEQ ID NO: 82, 231 to 400 contiguous amino acid residues (e.g., 235, 265, 280, 285, 295, 305, 315, 325, 335, 345, 355, 365, 375, 385, 395, or 399 contiguous amino acid residues) of SEQ ID NO: 82, or 231 to 300 contiguous amino acid residues (e.g., 240, 250, 260, 270, or 299 contiguous amino acid residues) of SEQ ID NO: 82, or a range defined by any two of the foregoing values.

The adenovirus or adenoviral vector can comprise one, two, three, or all four of the aforementioned amino acid sequences alone or in any combination. In this respect, the adenovirus or adenoviral vector can comprise any combination of any two of the aforementioned sequences, any combination of any three of the aforementioned sequences, or all four of the aforementioned sequences. For example, the adenovirus or adenoviral vector can comprise an amino acid sequence comprising at least 89 contiguous amino acid residues of SEQ ID NO: 78. The adenovirus or adenoviral vector can comprise an amino acid sequence comprising at least 89 contiguous amino acid residues of SEQ ID NO: 78, and an amino acid sequence comprising at least 230 contiguous amino acid residues of SEQ ID NO: 81. The adenovirus or adenoviral vector can comprise an amino acid sequence comprising at least 89 contiguous amino acid residues of SEQ ID NO: 78, an amino acid sequence comprising at least 247 contiguous amino acid residues of SEQ ID NO: 80, and an amino acid sequence comprising at least 230 contiguous amino acid residues of SEQ ID NO: 81. The adenovirus or adenoviral vector can comprise an amino acid sequence comprising at least 89 contiguous amino acid residues of SEQ ID NO: 78, an amino acid sequence comprising at least 247 contiguous amino acid residues of SEQ ID NO: 80, and an amino acid sequence comprising at least 231 contiguous amino acid residues of SEQ ID NO: 82. The adenovirus or adenoviral vector can comprise (a) an amino acid sequence comprising at least 89 contiguous amino acid residues of SEQ ID NO: 78, (b) an amino acid sequence comprising at least 247 contiguous amino acid residues of SEQ ID NO: 80, (c) an amino acid sequence comprising at least 230 contiguous amino acid residues of SEQ ID NO: 81, and (d) an amino acid sequence comprising at least 231 contiguous amino acid residues of SEQ ID NO: 82.

In other embodiments, the adenovirus or adenoviral vector comprises one or more nucleic acid sequences that encode one or more of any of the aforementioned amino acid sequences, e.g., the amino acid sequences of any of SEQ ID NOs: 73-82 or any of the variants and/or portions thereof as described herein. For example, the adenovirus or adenoviral vector can comprise a nucleic acid sequence encoding an amino acid sequence that is at least 99.5% identical (e.g., at least 99.59%, at least 99.69%, at least 99.78%, at least 99.88%, at least 99.97%, or 100% identical) to SEQ ID NO: 79, or a nucleic acid sequence encoding an amino acid sequence that is at least 95% identical (e.g., at least 97.94% or 100% identical) to SEQ ID NO: 74.

The adenovirus or adenoviral vector can comprise the nucleic acid sequence of for example, SEQ ID NO: 21, SEQ ID NO: 22, SEQ ID NO: 23, SEQ ID NO: 24, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 83, SEQ ID NO: 84, SEQ ID NO: 85, SEQ ID NO: 86, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, or SEQ ID NO: 98.

As discussed herein, the adenovirus or adenoviral vector can be replication-competent, conditionally-replicating, or replication-deficient. Preferably, the adenovirus or adenoviral vector is replication-deficient, such that the replication-deficient adenovirus or adenoviral vector requires complementation of at least one replication-essential gene function of one or more regions of the adenoviral genome for propagation (e.g., to form adenoviral vector particles).

The replication-deficient adenovirus or adenoviral vector can be modified in any suitable manner to cause the deficiencies in the one or more replication-essential gene functions in one or more regions of the adenoviral genome for propagation. The complementation of the deficiencies in the one or more replication-essential gene functions of one or more regions of the adenoviral genome refers to the use of exogenous means to provide the deficient replication-essential gene functions. Such complementation can be effected in any suitable manner, for example, by using complementing cells and/or exogenous DNA (e.g., helper adenovirus) encoding the disrupted replication-essential gene functions.

The adenovirus or adenoviral vector can be deficient in one or more replication-essential gene functions of only the early regions (i.e., E1-E4 regions) of the adenoviral genome, only the late regions (i.e., L1-L5 regions) of the adenoviral genome, both the early and late regions of the adenoviral genome, or all adenoviral genes (i.e., a high capacity adenovector (HC-Ad). See Morsy et al., *Proc. Natl. Acad. Sci. USA*, 95: 965-976 (1998); Chen et al., *Proc. Natl. Acad. Sci. USA*, 94: 1645-1650 (1997); and Kochanek et al., *Hum. Gene Ther.*, 10: 2451-2459 (1999). Examples of replication-deficient adenoviral vectors are disclosed in U.S. Pat. Nos. 5,837,511; 5,851,806; 5,994,106; 6,127,175; 6,482,616; and 7,195,896, and International Patent Application Publications WO 1994/028152, WO 1995/002697, WO 1995/016772, WO 1995/034671, WO 1996/022378, WO 1997/012986, WO 1997/021826, and WO 2003/022311.

The early regions of the adenoviral genome include the E1, E2, E3, and E4 regions. The E1 region comprises the E1A and E1B subregions, and one or more deficiencies in replication-essential gene functions in the E1 region can include one or more deficiencies in replication-essential gene functions in either or both of the E1A and E1B subregions, thereby requiring complementation of the E1A subregion and/or the E1B subregion of the adenoviral genome for the adenovirus or adenoviral vector to propagate (e.g., to form adenoviral vector particles). The E2 region comprises the E2A and E2B subregions, and one or more deficiencies in replication-essential gene functions in the E2 region can include one or more deficiencies in replication-essential gene functions in either or both of the E2A and E2B subregions, thereby requiring complementation of the E2A subregion and/or the E2B subregion of the adenoviral genome for the adenovirus or adenoviral vector to propagate (e.g., to form adenoviral vector particles).

The E3 region does not include any replication-essential gene functions, such that a deletion of the E3 region in part or in whole does not require complementation of any gene functions in the E3 region for the adenovirus or adenoviral vector to propagate (e.g., to form adenoviral vector particles). In the context of the invention, the E3 region is defined as the region that initiates with the open reading frame that encodes a protein with high homology to the 12.5K protein from the E3 region of human adenovirus 5 (NCBI reference sequence AP_000218) and ends with the open reading frame that encodes a protein with high homology to the 14.7K protein from the E3 region of human adenovirus 5 (NCBI reference sequence AP_000224.1). The E3 region may be deleted in whole or in part, or retained in whole or in part. The size of the deletion may be tailored so as to retain an adenovirus or adenoviral vector whose genome closely matches the optimum genome packaging size. A larger deletion will accommodate the insertion of larger heterologous nucleic acid sequences in the adenovirus or adenoviral genome. In one embodiment of the invention, the L4 polyadenylation signal sequences, which reside in the E3 region, are retained.

The E4 region comprises multiple open reading frames (ORFs). An adenovirus or adenoviral vector with a deletion of all of the open reading frames of the E4 region except ORF6, and in some cases ORF3, does not require complementation of any gene functions in the E4 region for the adenovirus or adenoviral vector to propagate (e.g., to form adenoviral vector particles). Conversely, an adenovirus or adenoviral vector with a disruption or deletion of ORF6, and in some cases ORF3, of the E4 region (e.g., with a deficiency in a replication-essential gene function based in ORF6 and/or ORF3 of the E4 region), with or without a disruption or deletion of any of the other open reading frames of the E4 region or the native E4 promoter, polyadenylation sequence, and/or the right-side inverted terminal repeat (ITR), requires complementation of the E4 region (specifically, of ORF6 and/or ORF3 of the E4 region) for the adenovirus or adenoviral vector to propagate (e.g., to foam adenoviral vector particles). The late regions of the adenoviral genome include the L1, L2, L3, L4, and L5 regions. The adenovirus or adenoviral vector also can have a mutation in the major late promoter (MLP), as discussed in International Patent Application Publication WO 2000/000628, which can render the adenovirus or adenoviral vector replication-deficient if desired.

The one or more regions of the adenoviral genome that contain one or more deficiencies in replication-essential gene functions desirably are one or more early regions of the adenoviral genome, i.e., the E1, E2, and/or E4 regions, optionally with the deletion in part or in whole of the E3 region.

The replication-deficient adenovirus or adenoviral vector also can have one or more mutations as compared to the wild-type adenovirus (e.g., one or more deletions, insertions, and/or substitutions) in the adenoviral genome that do not inhibit viral replication in host cells. Thus, in addition to one or more deficiencies in replication-essential gene functions, the adenovirus or adenoviral vector can be deficient in other respects that are not replication-essential. For example, the adenovirus or adenoviral vector can have a partial or entire deletion of the adenoviral early region known as the E3 region, which is not essential for propagation of the adenovirus or adenoviral genome.

In one embodiment, the adenovirus or adenoviral vector is replication-deficient and requires, at most, complementation of the E1 region or the E4 region of the adenoviral genome, for propagation (e.g., to form adenoviral vector particles). Thus, the replication-deficient adenovirus or adenoviral vector requires complementation of at least one replication-essential gene function of the E1A subregion and/or the E1B region of the adenoviral genome (denoted an E1-deficient adenoviral vector) or the E4 region of the adenoviral genome (denoted an E4-deficient adenoviral vector) for propagation (e.g., to form adenoviral vector particles). The adenovirus or adenoviral vector can be deficient in at least one replication-essential gene function (desirably all replication-essential gene functions) of the E1 region of the adenoviral genome and at least one gene function of the nonessential E3 region of the adenoviral genome (denoted an E1/E3-deficient adenoviral vector). The adenovirus or adenoviral vector can be deficient in at least one replication-essential gene function (desirably all replication-essential gene functions) of the E4 region of the adenoviral genome and at least one gene function of the nonessential E3 region of the adenoviral genome (denoted an E3/E4-deficient adenoviral vector).

In one embodiment, the adenovirus or adenoviral vector is replication-deficient and requires, at most, complementation of the E2 region, preferably the E2A subregion, of the adenoviral genome, for propagation (e.g., to form adenoviral vector particles). Thus, the replication-deficient adenovirus or adenoviral vector requires complementation of at least one replication-essential gene function of the E2A subregion of the adenoviral genome (denoted an E2A-deficient adenoviral vector) for propagation (e.g., to form adenoviral vector particles). The adenovirus or adenoviral vector can be deficient in at least one replication-essential gene function (desirably all replication-essential gene functions) of the E2A region of the adenoviral genome and at least one gene function of the nonessential E3 region of the adenoviral genome (denoted an E2A/E3-deficient adenoviral vector).

In one embodiment, the adenovirus or adenoviral vector is replication-deficient and requires, at most, complementation of the E1 and E4 regions of the adenoviral genome for propagation (e.g., to form adenoviral vector particles). Thus, the replication-deficient adenovirus or adenoviral vector requires complementation of at least one replication-essential gene function of both the E1 and E4 regions of the adenoviral genome (denoted an E1/E4-deficient adenoviral vector) for propagation (e.g., to form adenoviral vector particles). The adenovirus or adenoviral vector can be deficient in at least one replication-essential gene function (desirably all replication-essential gene functions) of the E1 region of the adenoviral genome, at least one replication-essential gene function of the E4 region of the adenoviral genome, and at least one gene function of the nonessential E3 region of the adenoviral genome (denoted an E1/E3/E4-deficient adenoviral vector). The adenovirus or adenoviral vector preferably requires, at most, complementation of the E1 region of the adenoviral genome for propagation, and does not require complementation of any other deficiency of the adenoviral genome for propagation. More preferably, the adenovirus or adenoviral vector requires, at most, complementation of the E1 and E4 regions of the adenoviral genome for propagation, and does not require complementation of any other deficiency of the adenoviral genome for propagation.

The adenovirus or adenoviral vector, when deficient in multiple replication-essential gene functions of the adenoviral genome (e.g., an E1/E4-deficient adenoviral vector), can include a spacer sequence to provide viral growth in a complementing cell line similar to that achieved by adenoviruses or adenoviral vectors deficient in a single replication-essential gene function (e.g., an E1-deficient adenoviral vector). The spacer sequence can contain any nucleotide sequence or sequences which are of a desired length, such as sequences at least about 15 base pairs (e.g., between about 15 nucleotides and about 12,000 nucleotides), preferably about 100 nucleotides to about 10,000 nucleotides, more preferably about 500 nucleotides to about 8,000 nucleotides, even more preferably about 1,500 nucleotides to about 6,000 nucleotides, and most preferably about 2,000 to about 3,000 nucleotides in length, or a range defined by any two of the foregoing values. The spacer sequence can be coding or non-coding and native or non-native with respect to the adenoviral genome, but does not restore the replication-essential function to the deficient region. The spacer also can contain an expression cassette. More preferably, the spacer comprises a polyadenylation sequence and/or a gene that is non-native with respect to the adenovirus or adenoviral vector. The use of a spacer in an adenoviral vector is further described in, for example, U.S. Pat. No. 5,851,806 and International Patent Application Publication WO 1997/021826.

By removing all or part of the adenoviral genome, for example, the E1, E3, and E4 regions of the adenoviral genome, the resulting adenovirus or adenoviral vector is able to accept inserts of exogenous nucleic acid sequences while retaining the ability to be packaged into adenoviral capsids. An exogenous nucleic acid sequence can be inserted at any position in the adenoviral genome so long as insertion in the position allows for the formation of adenovirus or the adenoviral vector particle. The exogenous nucleic acid sequence preferably is positioned in the E1 region, the E3 region, or the E4 region of the adenoviral genome.

The replication-deficient adenovirus or adenoviral vector of the invention can be produced in complementing cell lines that provide gene functions not present in the replication-deficient adenovirus or adenoviral vector, but required for viral propagation, at appropriate levels in order to generate high titers of viral vector stock. Such complementing cell lines are known and include, but are not limited to, 293 cells (described in, e.g., Graham et al., *J. Gen. Virol.*, 36: 59-72 (1977)), PER.C6 cells (described in, e.g., International Patent Application Publication WO 1997000326, and U.S. Pat. Nos. 5,994,128 and 6,033,908), and 293-ORF6 cells (described in, e.g., International Patent Application Publication WO 1995/034671 and Brough et al., *J. Virol.*, 71: 9206-9213 (1997)). Other suitable complementing cell lines to produce the replication-deficient adenovirus or adenoviral vector of the invention include complementing cells that have been generated to propagate adenoviral vectors encoding transgenes whose expression inhibits viral growth in host cells (see, e.g., U.S. Patent Application Publication 2008/0233650). Additional suitable complementing cells are described in, for example, U.S. Pat. Nos. 6,677,156 and 6,682,929, and International Patent Application Publication WO 2003/020879. In some instances, the cellular genome need not comprise nucleic acid sequences, the gene products of which complement for all of the deficiencies of a replication-deficient adenoviral vector. One or more replication-essential gene functions lacking in a replication-deficient adenoviral vector can be supplied by a helper virus, e.g., an adenoviral vector that supplies in trans one or more essential gene functions required for replication of the replication-deficient adenovirus or adenoviral vector. Alternatively, the inventive adenovirus or adenoviral vector can comprise a non-native replication-essential gene that complements for the one or more replication-essential gene functions lacking in the inventive replication-deficient adenovirus or adenoviral vector. For example, an E1/E4-deficient adenoviral vector can be engineered to contain a nucleic acid sequence encoding E4 ORF 6 that is obtained or derived from a different adenovirus (e.g., an adenovirus of a different serotype than the inventive adenovirus or adenoviral vector, or an adenovirus of a different species than the inventive adenovirus or adenoviral vector).

The adenovirus or adenoviral vector can further comprise a transgene. The term "transgene" is defined herein as a non-native nucleic acid sequence that is operably linked to appropriate regulatory elements (e.g., a promoter), such that the non-native nucleic acid sequence can be expressed to produce a protein (e.g., peptide or polypeptide). The regulatory elements (e.g., promoter) can be native or non-native to the adenovirus or adenoviral vector.

A "non-native" nucleic acid sequence is any nucleic acid sequence (e.g., DNA, RNA, or cDNA sequence) that is not a naturally occurring nucleic acid sequence of an adenovirus in a naturally occurring position. Thus, the non-native nucleic acid sequence can be naturally found in an adenovirus, but located at a non-native position within the adenoviral genome and/or operably linked to a non-native promoter. The terms "non-native nucleic acid sequence," "heterologous nucleic acid sequence," and "exogenous nucleic acid sequence" are synonymous and can be used interchangeably in the context of the invention. The non-native nucleic acid sequence preferably is DNA and preferably encodes a protein (i.e., one or more nucleic acid sequences encoding one or more proteins).

The adenovirus or adenoviral vector preferably comprises at least one non-native nucleic acid that encodes an antigen of RSV. An "antigen" is a molecule that triggers an immune response in a mammal. An "immune response" can entail, for example, antibody production and/or the activation of immune effector cells. An antigen in the context of the invention can comprise any subunit, fragment, or epitope of any proteinaceous or non-proteinaceous (e.g., carbohydrate or lipid) molecule which provokes an immune response in a mammal. By "epitope" is meant a sequence of an antigen that is recognized by an antibody or an antigen receptor. Epitopes also are referred to in the art as "antigenic determinants." The antigen can be a protein or peptide of viral, bacterial, parasitic, fungal, protozoan, prion, cellular, or extracellular origin, which provokes an immune response in a mammal, preferably leading to protective immunity. The antigen also can be a self antigen, i.e., an autologous protein which the body has mistakenly identified as a foreign invader.

An RSV antigen in the context of the invention can comprise any proteinaceous RSV molecule or portion thereof that provokes an RSV-related immune response in a mammal. An "RSV molecule" is a molecule that is a part of a respiratory syncytial virus, is encoded by a nucleic acid sequence of a respiratory syncytial virus, or is derived from or synthetically based upon any such molecule. Administration of an RSV antigen that provokes an immune response in accordance with the invention preferably leads to protective immunity against RSV. In this regard, an "immune response" to RSV is an immune response to any one or more RSV antigens.

RSV is classified in the *Pneumovirus* genus of the Paramyxoviridae family (Collins et al., supra; Lamb & Kolakofsky, "Paramyxoviridae: the viruses and their replication," In: *Fields Virology*, Knipe & Howley (eds.), Lippincott, Williams & Wilkins, Philadelphia (2001), pp. 1305-1340). The RSV genome comprises a negative-sense polynucleotide molecule which, through complementary viral mRNAs, encodes eleven viral proteins: the nonstructural proteins NS1 and NS2, N, P, matrix (M), small hydrophobic (SH), glycoprotein (G), fusion (F), M2(ORF1) (also known as M2-1), M2(ORF2) (also known as M2-2), and L (see, e.g., Mink et al., *Virology*, 185: 615-624 (1991); Stec et al., *Virology*, 183: 273-287 (1991); and Connors et al., *Virol.*, 208: 478-484 (1995)). The nucleocapsid protein (N), phosphoprotein (P), and large polymerase protein (L) constitute the minimal components for viral RNA replication and transcription in vitro (Grosfield et al., *J. Virol.*, 69: 5677-5686 (1995); Yu et al., *J. Virol.*, 69: 2412-2419 (1995); U.S. Pat. Nos. 6,264,957 and 6,790,449; and International Patent Application Publication WO 1997/012032)). The N protein associates with the genomic RNA to form the nucleocapsid, which serves as the template for RNA synthesis. The L protein is a multifunctional protein that contains RNA-dependent RNA polymerase catalytic motifs and also is likely responsible for capping and polyadenylation of viral mRNAs. However, the L protein alone is not sufficient for the polymerase function; the P protein is also required. The M2(ORF1) protein is a transcription antitermination factor required for processive RNA synthesis and transcription read-through at gene junctions (Collins et al., supra; Hardy et al., *J. Virol.*, 73: 170-176 (1999); Hardy & Wertz, *J. Virol.*, 72: 520-526 (1998)). M2 (ORF1) also is known as RNA polymerase elongation factor and is needed for the recovery of infectious RSV. The M2(ORF2) protein is involved in the switch between viral RNA transcription and replication (Bermingham & Collins, *Proc. Natl. Acad. Sci. USA*, 96: 11259-11264 (1999); Jin et al., *J. Virol.*, 74: 74-82 (2000)). The NS1 and NS2 proteins have been shown to inhibit minigenome synthesis in vitro (Atreya et al., *J. Virol.*, 72: 1452-1461 (1998)).

The F (fusion) and G (attachment) glycoproteins are the two major protective antigens of RSV (Walsh et al., *J. Infect. Dis.*, 155: 1198-1204 (1987)). The F protein is synthesized as a 68 kDa precursor molecule ($F_0$) which is proteolytically cleaved into disulfide-linked $F_1$ (about 48 kDa) and $F_2$ (about 20 kDa) polypeptide fragments (Walsh et al., *J. Virol.*, 47: 171-177 (1983)). The G protein is a heavily O-glycosylated glycoprotein of apparent molecular weight of about 90 kDa (Levine et al., *J. Gen. Virol.*, 69: 2521-2524 (1987)). Two broad subtypes of RSV have been defined: RSV-A and RSV-B. The major antigenic differences between these subtypes are found in the G glycoprotein, while the F glycoprotein is more conserved (Wertz et al., *J. Virol.*, 61 (10): 3163-3166 (1987)).

In the context of the invention, the RSV antigen can include all or an immunogenic part of, for example, the NS1 protein, the NS2 protein, the N protein, the P protein, the M protein, the SH protein, the G protein, the F protein, the M2-1 protein, the M2-2 protein, and the L protein. Preferably, the RSV antigen includes all or an immunogenic part of the F protein. In this respect, RSV infection of infants has been shown to induce antibodies to F and G, but F-specific responses are more consistently neutralizing (see, e.g., Welliver et al., *J. Clin. Microbiol.*, 27(2): 295-299 (1989); Ward et al., *J. Gen. Virol.*, 64 (Pt 9): 1867-76 (1983); Hendry et al., *J. Infect. Dis.*, 157(4): 640-647 (1988); Wagner et al., *J. Clin. Microbiol.*, 24(2): 304-306 (1986); Johnson et al., *J. Virol.*, 61(10): 3163-3166 (1987); and Murphy et al., *J. Clin. Microbiol.*, 23(6): 1009-1014 (1986)). An inverse correlation has been observed between the amount of neutralizing antibodies to F and G and the severity of illness (Fernald et al., *Pediatr. Res.*, 17(9): 753-758 (1983)). Both immunization with F and passive transfer of anti-F monoclonal antibodies have been shown to protect mice and cotton rats against RSV (see, e.g., Johnson et al., supra; Olmsted et al., *Proc. Natl. Acad. Sci. USA*, 83(19): 7462-7466 (1986); Taylor et al., *Immunology*, 52(1): 137-142 (1984); Walsh et al., *J. Infect. Dis.*, 155(6): 1198-204 (1987); and Walsh et al., *Infect. Immun.*, 43(2): 756-8 (1984)), and antibody induced by F is cross-protective against heterologous RSV strains (Johnson et al., supra). There is also evidence that antibodies to F are sufficient to protect against disease in humans (see, e.g., Parnes et al., *Pediatr. Pulmonol.*, 35(6): 484-489 (2003); and Sorrentino et al., *Pediatr. Infect. Dis. J.*, 19(11): 1068-1071 (2000)).

In a preferred embodiment, the RSV-encoding nucleic acid sequence comprises codons expressed more frequently (and preferably, most frequently) in humans than in RSV. While the genetic code is generally universal across species, the choice among synonymous codons is often species-dependent. RSV replicates in the cytoplasm; however, the RSV antigen encoded by the inventive adenoviral vector is expressed in the nucleus. The native mRNAs of RSV have cis signals that reduce the number of mRNAs that are transported from the nucleus. One of ordinary skill in the art would appreciate that, to achieve maximum protection against RSV infection, the adenovirus or adenoviral vector must be capable of expressing high levels of RSV antigens in a mammalian, preferably a human, host. In this respect, the nucleic acid sequence preferably encodes the native amino acid sequence of an RSV antigen, but comprises codons that are expressed more frequently in mammals (e.g., humans) than in RSV, and lacks cis signals that are inhibitory to high level expression of the RSV antigen. Changing native RSV codons to the most frequently used in mammals will increase expression of the RSV antigen in a mammal (e.g., a human) (see, e.g., Kim et al., *Vaccine*, 28(22): 3801-3808 (2010)). Such modified nucleic acid sequences are commonly described in the art as "humanized," as "codon-optimized," or as utilizing "mammalian-preferred" or "human-preferred" codons.

In the context of the invention, an RSV nucleic acid sequence is said to be "codon-optimized" if at least about 60% (e.g., at least about 70%, at least about 80%, or at least about 90%) of the wild-type codons in the nucleic acid sequence are modified to encode mammalian-preferred codons. That is, an RSV nucleic acid sequence is codon-optimized if at least about 60% of the codons in the nucleic acid sequence are mammalian-preferred codons. Preferred codon-optimized nucleic acid sequences encoding an RSV F protein comprise, consist essentially of, or consist of SEQ ID NO: 25, SEQ ID NO: 61, or SEQ ID NO: 87, which encode the amino acid sequences of SEQ ID NO: 26, SEQ ID NO: 62, and SEQ ID NO: 88, respectively. However, the invention is not limited to this exemplary sequence. Indeed, genetic sequences can vary between different strains, and this natural scope of allelic variation is included within the scope of the invention. Codon-optimized nucleic acid sequences encoding RSV antigens are disclosed in, for example, International Patent Application Publication WO 2008/133663. Additionally and alternatively, the codon-optimized nucleic acid sequence encoding an RSV antigen can be any sequence that hybridizes to an above-described sequence under at least moderate, preferably high, stringency conditions, such as described in, e.g., Sambrook et al., *Molecular Cloning, a Laboratory Manual*, 3rd edition, Cold Spring Harbor Press, Cold Spring Harbor, N.Y. (2001). Determining the degree of homology can be accomplished using any suitable method known in the art, such as those described herein.

In addition to the nucleic acid encoding an RSV antigen, the adenovirus or adenoviral vector preferably comprises expression control sequences, such as promoters, enhancers, polyadenylation signals, transcription terminators, internal ribosome entry sites (IRES), and the like, that provide for the expression of the nucleic acid sequence in a host cell. Exemplary expression control sequences are known in the art and are described in, for example, Goeddel, *Gene Expression Technology: Methods in Enzymology*, Vol. 185, Academic Press, San Diego, Calif. (1990). Ideally, the RSV antigen-encoding nucleic acid sequence is operably linked to a promoter and a polyadenylation sequence. The promoter desirably is a constitutive or inducible promoter, preferably a constitutive promoter, A large number of promoters, including constitutive, inducible, and repressible promoters, from a variety of different sources are well known in the art. Representative sources of promoters include for example, virus, mammal, insect, plant, yeast, and bacteria, and suitable promoters from these sources are readily available, or can be made synthetically, based on sequences publicly available, for example, from depositories such as the ATCC as well as other commercial or individual sources. Promoters can be unidirectional (i.e., initiate transcription in one direction) or bi-directional (i.e., initiate transcription in either a 3' or 5' direction). Non-limiting examples of promoters include, for example, the T7 bacterial expression system, pBAD (araA) bacterial expression system, the cytomegalovirus (CMV) promoter, the SV40 promoter, and the Rous Sarcoma Virus promoter. Inducible promoters include, for example, the Tet system (U.S. Pat. Nos. 5,464,758 and 5,814,618), the Ecdysone inducible system (No et al., *Proc. Natl. Acad. Sci.*, 93: 3346-3351 (1996)), the T-REx™ system (Invitrogen, Carlsbad, Calif.), LACSWITCH™ system (Stratagene, San Diego, Calif.), and the Cre-ERT tamoxifen inducible recombinase system (Indra et al., *Nuc. Acid. Res.*, 27: 4324-4327 (1999); *Nuc. Acid. Res.*, 28: e99 (2000); U.S. Pat. No. 7,112,715; and Kramer & Fussenegger, *Methods Mol. Biol.*, 308: 123-144 (2005)).

A promoter can be selected by matching its particular pattern of activity with the desired pattern and level of expression of an antigen(s). For example, the adenovirus or adenoviral vector can comprise two or more nucleic acid sequences that encode the same or different antigens and are operably linked to different promoters displaying distinct expression profiles. In this regard, a first promoter can be selected to mediate an initial peak of antigen production, thereby priming the immune system against an encoded antigen. A second promoter can be selected to drive production of the same or different antigen such that expression peaks several days after that of the first promoter, thereby "boosting" the immune system against the antigen. Alternatively, a hybrid promoter can be constructed which combines the desirable aspects of multiple promoters. For example, a CMV-Rous Sarcoma Virus hybrid promoter combining the CMV promoter's initial rush of activity with the Rous Sarcoma Virus promoter's high maintenance level of activity can be employed. In that antigens can be toxic to eukaryotic cells, it may be advantageous to modify the promoter to decrease activity in complementing cell lines used to propagate the adenovirus or adenoviral vector.

To optimize protein production, preferably the antigen-encoding nucleic acid sequence further comprises a polyadenylation site following the coding sequence. Any suitable polyadenylation sequence can be used, including a synthetic optimized sequence, as well as the polyadenylation sequence of BGH (Bovine Growth Hormone), polyoma virus, TK (Thymidine Kinase), EBV (Epstein Barr Virus), and the papillomaviruses, including human papillomaviruses and BPV (Bovine Papilloma Virus). A preferred polyadenylation sequence is the SV40 (Human Sarcoma Virus-40) polyadenylation sequence. Also, preferably all the proper transcription signals (and translation signals, where appropriate) are correctly arranged such that the nucleic acid sequence is properly expressed in the cells into which it is introduced. If desired, the nucleic acid sequence also can incorporate splice sites (i.e., splice acceptor and splice donor sites) to facilitate mRNA production.

If the RSV antigen-encoding nucleic acid sequence encodes a processed or secreted protein or peptide, or a protein that acts intracellularly, preferably the RSV antigen-encoding nucleic acid sequence further comprises the appropriate sequences for processing, secretion, intracellular localization, and the like. The RSV antigen-encoding nucleic acid sequence can be operably linked to a signal sequence, which targets a protein to cellular machinery for secretion. Appropriate signal sequences include, but are not limited to, leader sequences for immunoglobulin heavy chains and cytokines (see, for example, Ladunga et al., *Current Opinions in Biotechnology*, 11: 13-18 (2000)).

Other protein modifications can be required to secrete a protein from a host cell, which can be determined using routine laboratory techniques. Preparing expression constructs encoding antigens and signal sequences is further described in, for example, U.S. Pat. No. 6,500,641. Methods of secreting non-secretable proteins are further described in, for example, U.S. Pat. No. 6,472,176, and International Patent Application Publication WO 2002/048377.

An RSV antigen encoded by the nucleic acid sequence of the adenovirus or adenoviral vector also can be modified to attach or incorporate the antigen on a host cell surface. In this respect, the antigen can comprise a membrane anchor, such as a gpi-anchor, for conjugation onto a cell surface. A transmembrane domain can be fused to the antigen to incorporate a terminus of the antigen protein into the cell membrane. Other strategies for displaying peptides on a cell surface are known in the art and are appropriate for use in the context of the invention.

The invention provides a composition comprising the adenovirus or adenoviral vector described herein and a carrier therefor (e.g., a pharmaceutically acceptable carrier). The composition desirably is a physiologically acceptable (e.g., pharmaceutically acceptable) composition, which comprises a carrier, preferably a physiologically (e.g., pharmaceutically) acceptable carrier, and the adenovirus or adenoviral vector. Any suitable carrier can be used within the context of the invention, and such carriers are well known in the art. The choice of carrier will be determined, in part, by the particular use of the composition (e.g., administration to an animal) and the particular method used to administer the composition. Ideally, in the context of replication-deficient adenoviral vectors, the pharmaceutical composition preferably is free of replication-competent adenovirus. The pharmaceutical composition optionally can be sterile.

Suitable compositions include aqueous and non-aqueous isotonic sterile solutions, which can contain anti-oxidants, buffers, and bacteriostats, and aqueous and non-aqueous sterile suspensions that can include suspending agents, solubilizers, thickening agents, stabilizers, and preservatives. The composition can be presented in unit-dose or multi-dose sealed containers, such as ampules and vials, and can be stored in a freeze-dried (lyophilized) condition requiring only the addition of the sterile liquid carrier, for example, water, immediately prior to use. Extemporaneous solutions and suspensions can be prepared from sterile powders, granules, and tablets. Preferably, the carrier is a buffered saline solution. More preferably, the adenovirus or adenoviral vector is part of a composition foimulated to protect the adenovirus or adenoviral vector from damage prior to administration. For example, the composition can be formulated to reduce loss of the adenovirus or adenoviral vector on devices used to prepare, store, or administer the adenovirus or adenoviral vector, such as glassware, syringes, or needles. The composition can be formulated to decrease the light sensitivity and/or temperature sensitivity of the adenovirus or adenoviral vector. To this end, the composition preferably comprises a pharmaceutically acceptable liquid carrier, such as, for example, those described above, and a stabilizing agent selected from the group consisting of polysorbate 80, L-arginine, polyvinylpyrrolidone, trehalose, and combinations thereof. Use of such a composition will extend the shelf life of the adenovirus or adenoviral vector, and facilitate its administration. Formulations for adenovirus or adenoviral vector-containing compositions are further described in, for example, U.S. Pat. No. 6,225,289, U.S. Pat. No. 6,514,943, and International Patent Application Publication WO 2000/034444.

The composition also can be formulated to enhance transduction efficiency. In addition, one of ordinary skill in the art will appreciate that the adenovirus or adenoviral vector can be present in a composition with other therapeutic or biologically-active agents. For example, factors that control inflammation, such as ibuprofen or steroids, can be part of the composition to reduce swelling and inflammation associated with in vivo administration of the adenovirus or adenoviral vector. Antibiotics, i.e., microbicides and fungicides, can be present to treat existing infection and/or reduce the risk of future infection, such as infection associated with gene transfer procedures.

The invention further provides a method of inducing an immune response against RSV in a mammal. The method comprises administering to the mammal the inventive adenovirus or adenoviral vector alone, preferably the inventive composition comprising the adenovirus or adenoviral vector and a pharmaceutically acceptable carrier, whereupon the nucleic acid sequence encoding the RSV antigen is expressed in the mammal to produce the RSV antigen and thereby induce an immune response against RSV in the mammal. In accordance with the invention, the composition is administered to an mammal, preferably a mammal, and most preferably a human, wherein the RSV antigen-encoding nucleic acid sequence is expressed to induce an immune response against RSV in the mammal. The human preferably is in a population that has a high risk of acquiring RSV. Such high-risk populations include, for example, neonates, young infants, the immunocompromised, and the elderly. Protection of neonates also may be achieved by administration of the composition to pregnant women. Most preferably, the human is 3 years old or younger (e.g., a human at or younger than any of about 2.5 years old, about 2 years old, about 1.5 years old, about 1 year old, about 9 months old, about 6 months old, about 3 months old, about 6 weeks old, about 4 weeks old, about 2 weeks old, about 1 week old, and about 1 day old) or 65 years old or older (e.g., a human at or older than any of about 70 years old, about 75 years old, about 80 years old, about 85 years old, about 90 years old, and about 95 years old).

The immune response can be a humoral immune response, a cell-mediated immune response, or, desirably, a combination of humoral and cell-mediated immunity. Ideally, the immune response provides protection to the animal, typically a mammal such as a human, upon subsequent challenge with RSV. However, protective immunity is not required in the context of the invention. The inventive method also can be used for antibody production and harvesting.

To enhance the immune response generated against an RSV antigen, the composition also can comprise an immune stimulator, or a nucleic acid sequence that encodes an immune stimulator. Immune stimulators also are referred to in the art as "adjuvants," and include, for example, cytokines, chemokines, or chaperones. Cytokines include, for example, Macrophage Colony Stimulating Factor (e.g., GM-CSF), Interferon Alpha (IFN-α), Interferon Beta (IFN-β), Interferon Gamma (IFN-γ), interleukins (IL-1, IL-2, IL-4, IL-5, IL-6, IL-8, IL-10, IL-12, IL-13, IL-15, IL-16, and IL-18), the TNF family of proteins, Intercellular Adhesion Molecule-1 (ICAM-1), Lymphocyte Function-Associated antigen-3 (LFA-3), B7-1, B7-2, FMS-related tyrosine kinase 3 ligand, (Flt3L), vasoactive intestinal peptide (VIP), and CD40 ligand. Chemokines include, for example, B Cell-Attracting chemokine-1 (BCA-1), Fractalkine, Melanoma Growth Stimulatory Activity (MGSA) protein, Hemofiltrate CC chemokine 1 (HCC-1), Interleukin 8 (IL-8), Interferon-stimulated T-cell alpha chemoattractant (1-TAC), Lymphot-actin, Monocyte Chemotactic Protein 1 (MCP-1), Monocyte Chemotactic Protein 3 (MCP-3), Monocyte Chemotactic Protein 4 (CP-4), Macrophage-Derived Chemokine (MDC), a macrophage inflammatory protein (MIP), Platelet Factor 4 (PF4), RANTES, BRAK, eotaxin, exodus 1-3, and the like. Chaperones include, for example, the heat shock proteins Hsp170, Hsc70, and Hsp40.

The composition ideally comprises an "effective amount" of adenoviral vector, i.e., a dose of adenoviral vector which provokes a desired immune response in the mammal. Desirably, a single dose of adenoviral vector comprises about $1 \times 10^5$ or more particles (which also are referred to as particle units (pu)) of the adenoviral vector, e.g., about $1 \times 10^6$ or more particles, about $1 \times 10^7$ or more particles, about $1 \times 10^8$ or more particles, about $1 \times 10^9$ or more particles, or about $3 \times 10^8$ or more particles of the adenoviral vector. Alternatively, or in addition, a single dose of adenoviral vector comprises about $3 \times 10^{14}$ particles or less of the adenoviral vector, e.g., about $1 \times 10^{13}$ particles or less, about $1 \times 10^{12}$ particles or less, about $3 \times 10^{11}$ particles or less, about $1 \times 10^{11}$ particles or less, about $1 \times 10^{10}$ particles or less, or about $1 \times 10^9$ particles or less of the adenoviral vector. Thus, a single dose of adenoviral vector can comprise a quantity of particles of the adenoviral vector in a range defined by any two of the aforementioned values. For example, a single dose of adenoviral vector can comprise $1 \times 10^5$-$1 \times 10^{14}$ particles, $1 \times 10^7$-$1 \times 10^{12}$ particles, $1 \times 10^8$-$1 \times 10^{11}$ particles, $3 \times 10^8$-$3 \times 10^{11}$ particles, $1 \times 10^9$-$1 \times 10^{12}$ particles, $1 \times 10^9$-$1 \times 10^{11}$ particles, $1 \times 10^9$-$1 \times 10^{10}$ particles, or $1 \times 10^{10}$-$1 \times 10^{12}$ particles, of the adenoviral vector. In other words, a single dose of adenoviral vector can comprise, for example, about $1 \times 10^6$ pu, $2 \times 10^6$ pu, $4 \times 10^6$ pu, $1 \times 10^7$ pu, $2 \times 10^7$ pu, $4 \times 10^7$ pu, $1 \times 10^8$ pu, $2 \times 10^8$ pu, $3 \times 10^8$ pu, $4 \times 10^8$ pu, $1 \times 10^9$ pu, $2 \times 10^9$ pu, $3 \times 10^9$ pu, $4 \times 10^9$ pu, $1 \times 10^{10}$ pu, $2 \times 10^{10}$ pu, $3 \times 10^{10}$ pu, $4 \times 10^{10}$ pu, $1 \times 10^{11}$ pu, $2 \times 10^{11}$ pu, $3 \times 10^{11}$ pu, $4 \times 10^{11}$ pu, $1 \times 10^{12}$ pu, $2 \times 10^{12}$ pu, $3 \times 10^{12}$ pu, or $4 \times 10^{12}$ pu of the adenoviral vector.

Administration of the composition containing the adenovirus or adenoviral vector can be one component of a multistep regimen for inducing an immune response against RSV in a mammal. In this respect, the method of inducing an immune response can further comprise administering to the mammal a boosting composition after administering the adenovirus or adenoviral vector to the mammal. In this embodiment, therefore, the immune response is "primed" upon administration of the composition containing the adenovirus or adenoviral vector, and is "boosted" upon administration of the boosting composition. Alternatively, the inventive method further comprises administering to the mammal a priming composition to the mammal prior to administering the adenovirus or adenoviral vector to the mammal. In this embodiment, therefore, the immune response is "primed" upon administration of the priming composition, and is "boosted" upon administration of the composition containing the adenovirus or adenoviral vector.

At least one of the priming composition and the boosting composition comprises an inventive adenovirus or adenoviral vector, while the other of the priming composition and the boosting composition can comprise the inventive adenovirus or adenoviral vector (which can be the same or different) or a different effective agent, though desirably a gene transfer vector that comprises a nucleic acid sequence encoding an RSV antigen. Any gene transfer vector can be employed, including viral and non-viral gene transfer vectors. Examples of suitable viral gene transfer vectors include, but are not limited to, retroviral vectors, adeno-associated virus vectors, vaccinia virus vectors, herpesvirus vectors, parainfluenza-RSV chimeric vectors (PIV-RSV), and adenoviral vectors. Examples of suitable non-viral vectors include, but are not limited to, plasmids, liposomes, and molecular conjugates (e.g., transferrin). Preferably, the priming composition or the boosting composition comprises a plasmid or an adenoviral vector. Alternatively, an immune response can be primed or boosted by administration of an RSV protein itself (e.g., an antigenic RSV protein) with or without a suitable adjuvant (e.g., alum, QS-21, insulin-derived adjuvant, etc.), a live-attenuated RSV particle, a virus-like particle, and the like. When the priming composition or the boosting composition comprises an adenovirus or an adenoviral vector other than the inventive adenovirus or adenoviral vector, the adenovirus or adenoviral vector can be, or can be derived from, any adenovirus that infects a human or non-human animal, which are well known in the art. In this respect, the priming composition or the boosting composition can comprise a human adenoviral vector (e.g., serotype 5, 28, or 35), a simian adenoviral vector (such as described in, e.g., International Patent Application Publication WO 2011/057254), or a gorilla adenoviral vector. For example, a priming composition containing a human serotype 5 adenoviral vector can be administered to a human, followed by administration of a boosting composition containing the inventive adenovirus or adenoviral vector described herein (i.e., a "heterologous" prime-boost regimen). Alternatively, a priming composition containing the inventive adenovirus or adenoviral vector described herein can be administered to a human, followed by administration of a boosting composition containing a human serotype 5 adenoviral vector. In another embodiment, a priming composition containing the inventive adenovirus or adenoviral vector described herein can be administered to a human, followed by a second administration of the same composition (i.e., a "homologous" prime-boost regimen). One of ordinary skill in the art will appreciate that any combination of human and/or non-human adenoviruses and adenoviral vectors encoding one or more RSV antigens can be employed as the priming and/or boosting compositions in conjunction with the inventive adenovirus or adenoviral vector described herein.

When a gene transfer vector other than the inventive adenovirus or adenoviral vector is utilized in the priming composition and/or the boosting composition, such gene transfer vector comprises at least one nucleic acid sequence encoding an RSV antigen. The RSV antigen encoded by the nucleic acid sequence of such a gene transfer vector can be the same as the RSV antigen encoded by the inventive adenovirus or adenoviral vector. Alternatively, the RSV antigen encoded by the nucleic acid sequence of such a gene transfer vector can be different from the RSV antigen encoded by the inventive adenovirus or adenoviral vector. In one embodiment, such a gene transfer vector of the priming composition and/or the boosting composition comprises multiple (i.e., two or more) nucleic acid sequences encoding the same RSV antigen, as described herein. In another embodiment, such a gene transfer vector of the priming composition and/or the boosting composition can comprise multiple nucleic acid sequences encoding two or more different RSV antigens, as described herein.

Administration of the priming composition and the boosting composition can be separated by any suitable timeframe (e.g., at least any of about 1 week, 2 weeks, 4 weeks, 8 weeks, 12 weeks, 16 weeks, 24 weeks, 52 weeks, 2 years, and 5 years, or any range defined by any two of the foregoing values). The boosting composition preferably is administered to a mammal (e.g., a human) at least about 2 weeks (e.g., at least any of about 3 weeks, 4 weeks, 5 weeks, 6 weeks, 7 weeks, 8 weeks, 9 weeks, 10 weeks, 11 weeks, 12 weeks, 13 weeks, 14 weeks, 15 weeks, 16 weeks, 20 weeks, 24 weeks, 28 weeks, 35 weeks, 40 weeks, 50 weeks, 52 weeks, 2 years, and 5 years, or any range defined by any two of the foregoing values) following administration of the priming composition. More than one dose of priming composition and/or boosting composition can be provided in any suitable timeframe. The dose of the priming composition and boosting composition administered to the mammal depends on a number of factors, including the extent of any side-effects, the particular route of administration, and the like.

The following examples further illustrate the invention but, of course, should not be construed as in any way limiting its scope.

EXAMPLE 1

This example demonstrates the immunogenicity of an inventive adenoviral vector encoding a Respiratory Syncytial Virus (RSV) F protein in cotton rats.

Three adenoviruses were prepared. Specifically, adenoviruses having the nucleic acid sequence of SEQ ID NO: 22, SEQ ID NO: 54, or SEQ ID NO: 84 were modified by genetic engineering to (1) be rendered replication-deficient by deletion of the E1 region and (2) express the human Respiratory Syncytial Virus (RSV) Fusion (F) glycoprotein.

More specifically, a nucleic acid sequence encoding the RSV F protein (e.g., SEQ ID NO: 25) was introduced between a CMVtetO promoter and the SV40 early polyA. The CMVtetO promoter combines the CMV immediate early high expression enhancerpromoter with tetracycline operator sites. Within this sequence is the viral enhancer, CAAT box, TATA box, two copies of the 20 nucleotide tetracycline operator sequence (tetO) from transposon Tn10, and the CMV transcription start site. The tetO sites are inactive in mammalian cells since tetracycline-based gene expression regulation is specific for a prokaryotic system (see, e.g., Blau et al., *Proc. Natl. Acad. Sci. USA.,* 96(3): 797-799 (1999)). The tetO sites inhibit transgene expression when the viral vector is propagated in a cell line in the presence of the tetracycline repressor. To further optimize the expression of the RSV F nucleic acid sequence from the CMVtetO promoter, an artificial intron was created in the sequence by placing a splice donor and a splice acceptor sequence upstream of the RSV F initiation codon.

Because RSV replicates in the cytoplasm of cells, the gene encoding the F protein was modified for expression in a cell nucleus by removing RNA processing signals (e.g., RNA splicing sites), and was codon-optimized for expression in a mammalian cell. The expression of the F protein from the adenoviral vectors was verified by infection of HEK-293 cells in vitro and by a Western blot assay using protein extracts of the infected cells and a commercially available anti-RSV polyclonal antibody (Pab7133P, Maine Biotechnology, Portland, Me.).

The adenoviral vectors were propagated in a genetically stable 293-ORF6-cell line that constitutively express the tetracycline repressor protein (TetR), which has been named M2A. The M2A cell line has been shown to efficiently reduce adenoviral vector transgene expression during adenoviral vector construction and growth (see, e.g., U.S. Patent Application Publication 2008/0233650 A1).

Experimental infection of cotton rats with live, replication-competent RSV has been demonstrated to safely protect the cotton rats against re-infection without development of disease-enhancing immune responses (Prince et al., *Lab Invest.*, 79: 1385-1392 (1999)). Cotton rats (5.5 weeks old) were immunized with $10^7$ or $10^9$ particle units (pu) of each of the F protein-encoding adenoviral vectors in 0.1 mL final formulation buffer (FFB) by intramuscular (i.m.) injection. Cotton rats were infected intranasally (i.n.) with $10^6$ plaque-forming units (PFU) of live RSV A2 as a positive control. As a negative control, cotton rats were immunized i.m. with 0.1 mL of adenovirus vector diluents (FFB). Serum was obtained from all of the cotton rats nine weeks after immunization (day 64).

To measure the levels of RSV-specific neutralizing antibodies induced by immunization, plaque reduction neutralization (PRNT) assays were performed. Specifically, dilutions of serum were incubated with RSV A2 (at a dilution determined to produce approximately 80 plaques per well) for 1 hour at 37° C. The RSV-serum mixtures were plated on subconfluent HEp-2 cell monolayers and were incubated for 4-5 days. The cells were then fixed and histologically stained, and RSV plaques (i.e., syncytia) were counted. The concentration of serum required to produce a 50% reduction in plaque number ($IC_{50}$) was determined for each sample, and the results are set forth in the bar graphs of FIGS. 1A-1C. Serum from FFB-immunized cotton rats had no detectable neutralizing antibody, while serum from cotton rats infected with live RSV had high levels of RSV-specific neutralizing antibody. Samples from cotton rats immunized with either $10^7$ or $10^9$ pu of the F protein-encoding adenoviral vector having SEQ ID NO: 22 or SEQ ID NO: 84 had $IC_{50}$ titers that were similar to the $IC_{50}$ titers in RSV-infected cotton rats. At the time point evaluated (nine weeks post-immunization), an immunogen dose of $10^9$ pu of the adenoviral vector having SEQ ID NO: 22 did not significantly increase titers of neutralizing antibody relative to an immunogen dose of $10^7$ pu of the adenoviral vector having SEQ ID NO: 22. Samples from cotton rats immunized with $10^9$ pu of the F protein-encoding adenoviral vector having SEQ ID NO: 54 had $IC_{50}$ titers that were similar to the $IC_{50}$ titers in RSV-infected cotton rats. However, samples from cotton rats immunized with $10^7$ pu of the F protein-encoding adenoviral vector having SEQ ID NO: 54 had $IC_{50}$ titers that were significantly lower than titers from RSV-infected cotton rats, and were not significantly greater that titers from FFB-immunized control cotton rats. At the time point evaluated (nine weeks post-immunization), an immunogen dose of $10^9$ puof the adenoviral vector having SEQ ID NO: 54 did not significantly increase titers of neutralizing antibody relative to an immunogen dose of $10^7$ pu of the adenoviral vector. In addition, at nine weeks post-immunization, an immunogen dose of $10^9$ pu of the adenoviral vector having SEQ ID NO: 84 significantly increased neutralizing antibody titers relative to an immunogen dose of $10^7$ of adenoviral vector.

The results of this example demonstrate that the inventive adenoviral vector encoding an RSV antigen is immunogenic at both low ($10^7$ pu) and high ($10^9$ pu) doses and is capable of inducing neutralizing antibody at titers similar to those generated by live RSV.

EXAMPLE 2

This example demonstrates the ability of an inventive adenoviral vector encoding an RSV F protein to protect cotton rats against RSV infection.

Cotton rats (5.5 weeks old) were immunized with $10^7$ or $10^9$ pu of the F protein-encoding adenoviral vectors as described in Example 1 diluted in 0.1 mL FFB. As a positive control, cotton rats were infected i.n. with $10^6$ PFU live RSV A2. As a negative control, cotton rats were injected i.m. with 0.1 ml FFB. Fifteen weeks after immunization (day 107), the cotton rats were anesthetized with isoflurane (5%) and then challenged i.n. with $10^6$ PFU RSV A2. Five days after RSV challenge, the cotton rats were euthanized by $CO_2$ narcosis, and the lungs of the cotton rats were removed for measurement of RSV replication. The lungs were homogenized, and dilutions of clarified lung supernatant were plated on subconfluent HEp-2 monolayers. The cultures were incubated 4-5 days, cells were then fixed and stained, and RSV plaques were counted. The data were calculated as the PFU/gram of lung tissue in each sample and set forth in the bar graphs of FIGS. 2A-2C.

Robust replication of RSV occurred in FFB-immunized cotton rats with high titers of RSV detected, while RSV infection completely protected against re-infection. Animals immunized with the adenoviral vectors at either the $10^7$ or $10^9$ pu dose were protected against RSV challenge with no detectable virus observed. Therefore, immunization of cotton rats with the F protein-encoding adenoviral vectors generated sufficient memory immune responses to prevent subsequent RSV infection, with levels of protective immunity comparable to that induced by exposure to live RSV.

The results of this example demonstrate that the inventive adenoviral vector encoding an RSV antigen induces protective immunity in a cotton rat model.

EXAMPLE 3

This example demonstrates the ability of an inventive adenoviral vector encoding an RSV F protein to protect BALBc mice against RSV infection.

BALBc mice (7 weeks old) were immunized in the tibialis anterior muscle (i.m.) with $10^7$ or $10^9$ pu of the adenoviral vectors as described in Example 1 diluted in 0.05 mL FFB. As a positive control, animals were infected i.n. with $10^6$ PFU live RSV A2. As a negative control, mice were injected i.m. with 0.05 ml FFB. Eight weeks after immunization (day 57), the mice were anesthetized with isoflurane (5%) and then challenged i.n. with $10^7$ PFU RSV A2. Five days after RSV challenge, the mice were euthanized by $CO_2$ narcosis, and the lungs of the mice were removed for measurement of RSV replication as described in Example 2. The data were calculated as the PFU/gram of lung tissue in each sample and set forth in the bar graphs of FIGS. 3A-3C.

Robust replication of RSV occurred in FFB-immunized mice with high titers of RSV detected, while RSV infection completely protected against re-infection. Animals immunized with the F protein-encoding adenoviral vector having SEQ ID NO: 22 or SEQ ID NO: 84 at either the $10^7$ or $10^9$ pu dose were fully protected against RSV challenge with no detectable virus observed. Animals immunized with the adenoviral vector having SEQ ID NO: 54 at the $10^9$ pu dose were fully protected against RSV challenge with no detectable virus observed. Therefore, immunization of BALBc mice with the F protein-encoding adenoviral vectors generated sufficient memory immune responses to prevent subsequent RSV infection, with levels of protective immunity comparable to that induced by exposure to live RSV.

The results of this example demonstrate that the inventive adenoviral vector encoding an RSV antigen induces protective immunity in a mouse model.

EXAMPLE 4

This example demonstrates the ability of an inventive adenoviral vector encoding an RSV F protein to protect mice and cotton rats against RSV infection.

A serotype 7 simian adenoviral vector was generated to (1) be rendered replication-deficient by deletion of the E1 region and (2) express the human Respiratory Syncytial Virus (RSV) Fusion (F) glycoprotein (SAV7.F0) using methods known in the art. Cotton rats and mice were immunized with a single intramuscular injection of SAV7.F0, the RSV F protein-encoding adenoviral vectors having SEQ ID NO: 22 and SEQ ID NO: 84 described in Example 1 (GC44.F0 and GC46.F0, respectively), or final formulation buffer (FFB). Positive control animals were immunized once intranasally with live RSV A2 (A strain) or RSV WV (B strain). RSV stocks were grown in HEp-2 cells. Cotton rats immunized with GC44.F0 and GC46.F0 were challenged intranasally with RSV A2 10 weeks post-immunization. Cotton rats immunized with SAV7.F0 were challenged intranasally with RSV WV four weeks post-immunization. RSV titers in lung and nose were measured by a plaque assay on HEp-2 monolayers.

Standard PRNT assays, such as those described in Example 1, were performed with live RSV A2 (strain A) and RSV WV (strain B) viruses. Neutralizing activity was reported as $IC_{50}$ values. Microneutralization (microN) assays were performed by mixing serum (1:500) from immunized cotton rats with serial three-fold dilutions of RSV. Viral replication was detected by staining with monoclonal anti-RSV F antibody (Millipore Corp., Billerica, Mass.), followed by staining with an HRP-conjugated goat anti-mouse IgG antibody (Jackson ImmunoResearch Laboratories, Inc., West Grove, Pa.). The colorometric endpoint reaction was read at $A_{450}$ (substrate) and $A_{540}$ (plate background).

The GC46.F0 adenoviral vector induced neutralizing antibodies when administered intra-muscularly. GC46.F0 also provided durable protection of the upper and lower respiratory tracts of immunized animals. The immune response protects against RSV A and B strains and neutralized clinical isolates. GC46.F0 administration showed no evidence of disease potentiation, and immunity that was not protective did not potentiate RSV disease.

The results of this example demonstrate that the inventive adenoviral vector encoding an RSV antigen induces protective immunity in animal models.

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Preferred embodiments of this invention are described herein, including the best mode known to the inventors for carrying out the invention. Variations of those preferred embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

SEQUENCE LISTING (98 sequences)

SEQ ID NO: 1 - DNA, 30 bp, Gorilla beringei beringei
agctctttggtggcgagcggcgcggcctct

SEQ ID NO: 2 - DNA, 439 bp, Gorilla beringei beringei
aacatcaatacctcaaagtcatggtcagggacactttcgccctcacccacacctccctccgcaaggcggcgcaggcctacgcgctgcccgtggagaagggctgttgcccctaccaggccgtcaaccagttctacatgctaggctcttaccgttcggacacggacgggtttcccctccaagagtactggaaagaccgcgaagagttcgtcctcaaccgcgagctgtggaaaaagaagggggaggataagtatgacatcatccgcgagaccctcgactactgcgcgctcgacgtccaggtcaccgccgagctggtgcacaagctgcgcgagtcctacgcctccttcgtcagggactcggtgggcttgcaagaagcaagcttcaacgtcttccagcggcccaccatctcctccaactcccatgccatcttcaggcagatcgc

SEQ ID NO: 3 - DNA, 34 bp, Gorilla beringei beringei
actgaggctgcggctaaggctgaggtcgaagcca

SEQ ID NO: 4 - DNA, 45 bp, Gorilla beringei beringei
ataggtgtggatgccacacaggcgggagataaccctatatatgct

SEQ ID NO: 5 - DNA, 30 bp, Gorilla beringei beringei
gtagcaggccccctagctgtggccaatggc

SEQ ID NO: 6 - DNA, 399 bp, Gorilla beringei beringei
atgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctgggtcaactgacccagcaggtctccagcttgcgtgagagcagccttgcctccccc

SEQ ID NO: 7 - DNA, 3168 bp, Gorilla beringei beringei
atggacagctccaatgtgcgcgatgtcgtcatcaaactccgcccgccgagcgccgagatctggacctgcggctctcgcggcgtggtggtctgctccaccatcgccctccaggagacagatgctggcggccagacaaccaaagtagaagaccaccagccacacgggaccccaggcgggggacttagattcccgctgcgcttcctcgtcagaggtcgccaggttcacctcgtgcaagatatacaacccgtgcagcgctgccagtactgcggtcgcttttacaaaagccagcacgagtgctcggcccgcagacgggacttctactttcaccacatcaacagccaatcctccaactggtggcgggagatccagttcttcccgatcggctctcatcctcgcacggagcgcctctttgtcacctacgatgtagagacctacacttggatgggagcctttggcaagcagctcgtgcccttcatgctggtcatgaaactggggggcgacgaggctctggtcgccgccgcgcgcgacctcgcccgagagctcagatgggacccctgggagaaagaccccctcaccttctactgcatcacccccgaaaagatggccgtggggcgacagttcagaaccttccgcgaccgcctgcagaccctcatggcccgcgacctctggcgatccttcctggcggccaaccctcacttgcaagactgggccctggaggagcacggcctggaatcgcccgaggagctcacctacgaggaactcaaaaagctcccctccatcaagggccagccccgctttttggagctctacatcgtgggccacaacataaacggctttgacgagatcgtcctggccgcccaggtcatcaacaaccgctcctcggtcccagggccctttcgcatcaccagaaacttcatgcctcgagcggggaagatcctcttcaatgacctcaccttctccctgcccaacccgcgctccaaaaagcgcacggactacaccctgtgggaacagggcggctgcgatgacacagacttcaaacatcaatacctcaaagtcatggtcagggacactttcgccctcacccacacctccctccgcaaggcggcgcaggcctacgcgctgcccgtggagaagggctgttgcccctaccaggccgtcaaccagttctacatgctaggctcttaccgttcggacacggacgggtttcccctccaagagtactggaaagaccgcgaagagttcgtcctcaaccgcgagctgtggaaaaagaagggggaggataagtatgacatcatccgcgagaccctcgactactgcgcgctcgacgtccaggtcaccgccgagctggtgcacaagctgcgcgagtcctacgcctccttcgtcagggactcggtgggcttgcaagaagcaagcttcaacgtcttccagcggcccaccatctcctccaactcccatgccatcttcaggcagatcgccttccgcgccgagcgcccccagcgcaccaacctcgggcccaacatgctggccccctcccacgagctctatgactacgtgcgcgccagcatccgcggggggcgctgctaccccacctacctcggcatcctcagggaacccctgtacgtgtatgacatctgcggcatgtacgcctccgcgctcacccaccccatgccctggggcccgcccctcaacccctacgagcgcgcgctcgccgcccgcgaatggcagcgggctctggacatgcaagcttgcaagatcgactactttgacccgcgcttgctccccggggtcttcaccatcgacgcggaccccccaaacgaggaccagctggaccccctaccccccttctgctcgcgcaagggcggccgcctctgctggaccaacgagcgcctgcgcggcgaggtcgccaccagcgtcgacatggtcaccctgcacaaccgaggctggagggtgcgcctaatcccagacgagcgcaccaccgtcttccccgagtggaagtgcgtggcccgcgagtacgtgcaactcaacatcgcggccaaggagcgagccgaccgcgacaaaaaccagaccctgcgctccatcgccaagctgctctccaacgccctctacgggtcgttcgccaccaagcttgacaacaaaaaaatagtgttttctgaccagatggacccaggtaccctcaaaggtatcacctccggacaggtgaacatcaaatcctcctcatttttagaaactgacaacctgagcgctgaggtcatgcccgccttcgagagggaatacttaccccagcagctggccctcgcagacagcgatgcggaagagagtgaagatgaaagggcgcccacccccttttatacccccccgtcgggaacccccggtcacgtgtcctacacctacaagccaatcacttttctggacgcggaggagggggacatgtgcctgcacaccctggagaaggtggacccgctagtggacaacgaccgctacccctcccacgtggcctccttcgtcctggcctggacgcgggccttcgtctcagagtggtcagagtttctctacgaggaggacagaggcactccgctggaagacaggcccctgaagtcggtctacggggacacggacagcctcttcgtcaccgagaagggacaccgcctcatggagagccgaggtaagaaacgcatcaaaaagcatgggggcaacctggtttttgaccctgaccgcccggagctcacttggctggtggaatgcgagacggtctgcgcttcctgcggcgcggacgcctactccccagagtccgtgtttctcgctcccaagctctacgccctgaagagcctgcagtgcccctcgtgcggcgccacctccaagggaaagctccgcgccaaggggcacgccgccgagggtctcgactacgagaccatggtcaaatgctacctggccgacgcgcagggcgaagagcggcagcgattcagcaccagcagaaccagcctcaagcgcaccctggccagcgcccaacccggagcgcaccccttcaccgtgacccagaccaccctgacgaggaccctgcgcccatggaaggacatgactctggccccgctggacgcccatcggctggtgccctacagcgaaagccgccccaacccgcgaaacgaggagatctgctggatcgagatgccg

SEQ ID NO: 8 - DNA, 1974 bp, Gorilla beringei beringei
atgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcacccagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttt

SEQ ID NO: 9 - DNA, 2877 bp, Gorilla beringei beringei
atggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagatgaaccagctcaggcagcaatagctgaagatgaagaagaacttgaagaagaacaagctcaggacgaacaggcgcccactaagaaaacccatgtatacgcccaggcacctctttctggtgaaaaaattactaaggatggtttgcaaataggtgtggatgccacacaggcgggagataaccctatatatgctgataaaacattccaacccgaacctcagataggtgagtctcagtggaacgaggctgatgccacagtagcaggaggcagagtcttaaaaaagaccacccctatgagaccttgctatggatcctatgccaaacctactaatgccaatggcggtcaagggatcatggtggccaatgatcagggagcgcttgaatctaaagttgagatgcaatttttctccaccacaacgtctcttaatgtaagggaaggtgaaaacaatcttcagccaaaagtagtgctatacagcgaagatgttaacttggaatcccctgacactcatttgtcttacaaacctaaaaaggatgacaccaactctaaaatcatgttgggtcagcaagccatgcccaacagacccaacctcattgcttttagggacaactttattggacttatgtactacaacagcacaggcaacatgggagtgctggcaggacaggcctcccagctaaacgctgtggtagacttgcaagacagaaacacagagctgtcataccaactgatgcttgattccattggagacagatcaagatacttttccatgtggaaccaggcagtggacagctatgacccagatgtcagaatcattgaaaaccatggggttgaagatgagctgcccaactattgctttcccctgggcggtattggaattacagacacataccagtgcataaaaccaaccgcagctgctaataacactacatggtctaaggatgaagaatttagtgatcgcaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaaaaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacc

SEQ ID NO: 10 - DNA, 1749 bp, Gorilla beringei beringei
atgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagatctgcaggcacccattgtctctcaaaatggaaaactggctctaaatgtagcaggccccctagctgtggccaatggcattaatgctttgacagtaggcacaggcaaaggtattggtctaaatgaaaccagcactcacttgcaagcaaagttggtcgcccccctaggctttgataccaatggcaacattaagctaagcgttgcaggaggcatgagactaaataatgacacacttatactagatgtaaactacccatttgaagctcaaggccaactaagtctaagagtgggccagggtccgctgtatgtagattctagcagccataacctgaccattagatgccttagaggattatacataacatcgtctaataaccaaaccggtctagaggccaacataaaactaacaaaaggccttgtctatgatggaaatgccatagcagtcaatgttggtcaaggattgcaatacagcactactgccacatcggaaggtgtgtatcctatacagtctaagataggtttgggaatggaatatgataccaacggagccatgatgacaaaactaggctctggactaagctttgacaattcaggagccattgtagtgggaaacaaaaatgatgacaggcttactctgtggactacaccagacccatctcctaactgtagaatttattctgaaaaagatactaaactaaccttggtgctgactaagtgtggcagccaaatcctaggcacagtatctgcccttgctgtcagaggcagccttgcgcccatcactaatgcatccagcatagtccaaatatttctaagatttgatgaaaatggactattgatgagcaactcatcgctagacggtgattactggaattacagaaatggggactccactaatagcacaccatatacaaatgcagtaggctttatgcctaatctagcagcctatcctaaaggtcaggctacagctgcaaaaagcagtattgtaagccaggtatacatggatggtgacactactaaacctataacactaaaaataaacttcaatggcattgatgaaacaacagaaaatacccctgttagtaaatattccatgacattctcatggagctggcccaccgcaagctacataggccacacttttgcaacaaactcttttactttctcctacatcgcccaagaa

SEQ ID NO: 11 - protein, 10 aa, Gorilla beringei beringei
SSLVASGAAS

SEQ ID NO: 12 - protein, 147 aa, Gorilla beringei beringei
KHQYLKVMVRDTFALTHTSLRKAAQAYALPVEKGCCPYQAVNQFYMLGSYRSDTDGFPLQEYWKDREEFVLNRELWKKKGEDKYDIIRETLDYCALDVQVTAELVHKLRESYASFVRDSVGLQEASFNVFQRPTISSNSHAIFRQIA

SEQ ID NO: 13 - protein, 15 aa, Gorilla beringei beringei
KTEAAAKAEVEANVA

SEQ ID NO: 14 - protein, 15 aa, Gorilla beringei beringei
IGVDATQAGDNPIYA

SEQ ID NO: 15 - protein, 15 aa, Gorilla beringei beringei
LNVAGPLAVANGINA

SEQ ID NO: 16 - protein, 133 aa, Gorilla beringei beringei
MSDTGNSFDGSIFSPYLTVRMPHWAGVRQNVMGSNVDGRPVLPSNSSTMAYATVGGTPLDAATSAAASAAAATARSMATDLYSSLVASGAASRASARDEKLTALLLKLEDLTRELGQLTQQVSSLRESSLASP

SEQ ID NO: 17 - protein, 1056 aa, Gorilla beringei beringei
MDSSNVRDVVIKLRPPSAEIWTCGSRGVVVCSTIALQETDAGGQTTKVEDHQPHGTPGGGLRFPLRFLVRGRQVHLVQDIQPVQRCQYCGRFYKSQHECSARRRDFYFHHINSQSSNWWREIQFFPIGSHPRTERLFVTYDVETYTWMGAFGKQLVPFMLVMKLGGDEALVAAARDLARELRWDPWEKDPLTFYCITPEKMAVGRQFRTFRDRLQTLMARDLWRSFLAANPHLQDWALEEHGLESPEELTYEELKKLPSIKGQPRFLELYIVGHNINGFDEIVLAAQVINNRSSVPGPFRITRNFMPRAGKILFNDLTFSLPNPRSKKRTDYTLWEQGGCDDTDFKHQYLKVMVRDTFALTHTSLRKAAQAYALPVEKGCCPYQAVNQFYMLGSYRSDTDGFPLQEYWKDREEFVLNRELWKKKGEDKYDIIRETLDYCALDVQVTAELVHKLRESYASFVRDSVGLQEASFNVFQRPTISSNSHAIFRQIAFRAERPQRTNLGPNMLAPSHELYDYVRASIRGGRCYPTYLGILREPLYVYDICGMYASALTHPMPWGPPLNPYERALAAREWQRALDMQACKIDYFDPRLLPGVFTIDADPPNEDQLDPLPPFCSRKGGRLCWTNERLRGEVATSVDMVTLHNRGWRVRLIPDERTTVFPEWKCVAREYVQLNIAAKERADRDKNQTLRSIAKLLSNALYGSFATKLDNKKIVFSDQMDPGTLKGITSGQVNIKSSSFLETDNLSAEVMPAFEREYLPQQLALADSDAEESEDERAPTPFYTPPSGTPGHVSYTYKPITFLDAEEGDMCLHTLEKVDPLVDNDRYPSHVASFVLAWTRAFVSEWSEFLYEEDRGTPLEDRPLKSVYGDTDSLFVTEKGHRLMESRGKKRIKKHGGNLVFDPDRPELTWLVECETVCASCGADAYSPESVFLAPKLYALKSLQCPSCGATSKGKLRAKGHAAEGLDYETMVKCYLADAQGEERQRFSTSRTSLKRTLASAQPGAHPFTVTQTTLTRTLRPWKDMTLAPLDAHRLVPYSESRPNPRNEEICWIEMP

SEQ ID NO: 18 - protein, 658 aa, Gorilla beringei beringei
MRRAAMFEEGPPPSYESAMGISPAAPLQPPYVPPRYLQPTGGRNSICYSELQPLYDTTRLYLVDNKSADVASLNYQNDHSDFLTTVIQNNDFTPTEASTQTINLDNRSNWGGDLKTILHTNMPNVNEFMFTNSFKARVMVAREQGEAKYEWVDFTLPEGNYSETMTLDLMNNAIVEHYLKVGRQNGVKESDIGVKFDTRNFRLGWDPVTGLVMPGVYTNEAFHPDIVLLPGCGVDFTQSRLSNLLGIRKRQPFQEGFKITYEDLKGGNIPALLDLDAYEESLKPEESAGDSGESGEEQAGGGGGASVENESTPAVAADAAEVEPEAMQQDAEEGAQEGAQKDMNDGEIRGDTFATRGEEKEAEAAAAATAEAETEVEAEAEPETEVMEDMNDGERRGDTFATRGEEKAAEAEAAAEEAAAAAAKTEAAAKAEVEANVAVEAQAEEEAAAEAVKEKAQAEQEEKKPVIQPLKEDSKKRSYNVIEGSTFTQYRSWYLAYNYGDPVKGVRSWTLLCTPDVTCGSEQMYWSLPNMMQDPVTFRSTRQVSNFPVVGAELLPVHSKSFYNEQAVYSQLIRQATSLTHVFNRFPENQILARPPAPTITTVSENVPALTDHGTLPLRNSISGVQRVTITDARRRTCPYVYKALGIVSPRVLSSRTF

SEQ ID NO: 19 - protein, 959 aa, Gorilla beringei beringei
MATPSMMPQWSYMHISGQDASEYLSPGLVQFARATDTYFNMSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWEQDEPAQAAIAEDEEELEEEQAQDEQAPTKKTHVYAQAPLSGEKITKDGLQIGVDATQAGDNPIYADKTFQPEPQIGESQWNEADATVAGGRVLKKTTPMRPCYGSYAKPTNANGGQGIMVANDQGALESKVEMQFFSTTTSLNVREGENNLQPKVVLYSEDVNLESPDTHLSYKPKKDDTNSKIMLGQQAMPNRPNLIAFRDNFIGLMYYNSTGNMGVLAGQASQLNAVVDLQDRNTELSYQLMLDSIGDRSRYFSMWNQAVDSYDPDVRIIENHGVEDELPNYCFPLGGIGITDTYQCIKPTAAANNTTWSKDEEFSDRNEIGVGNNFAMEINIQANLWRNFLYANVGLYLPDKLKYNPTNVDISDNPNTYDYMNKRVVAPGLVDCFVNVGARWSLDYMDNVNPFNHHRNAGLRYRSMILGNGRYVPFHIQVPQKFFAIKNLLLLPGSYTYEWNFRKDVNMVLQSSLGNDLRVDGASIKFDSVTLYATFFPMAHNTASTLEAMLRNDTNDQSFNDYLSGANMLYPIPAKATNVPISIPSRNWAAFRGWAFTRLKTKETPSLGSGFDPYFVYSGSIPYLDGTFYLNHTFKKISIMYDSSVSWPGNDRLLTPNEFEVKRAVDGEGYNVAQCNMTKDWFLVQMLANYNIGYQGFYIPESYKDRMYSFFRNFQPMSRQVVDETKYKDYQAIGITHQHNNSGFVGYLAPTMREGQAYPANFPYPLIGKTAVDSVTQKKFLCDRTLWRIPFSSNFMSMGALTDLGQNLLYANSAHALDMTFEVDPMDEPTLLYIVFEVFDVVRVHQPHRGVIETVYLRTPFSAGNATT

SEQ ID NO: 20 - protein, 583 aa, Gorilla beringei beringei
MKRARSSDETFNPVYPYDTEIAPTSVPFLTPPFVSSAGMQENPAGVLSLHLSEPLTTHNGALTLKMGGGLTLDKEGNLTSQNITSVDPPLKKSKNNISLQTAAPLAVSSGALTLFATPPLAVSGDNLTVQSQAPLTLEDSKLTLATKGPLTVSEGKLVLETEAPLHASDSSSLGLSVTAPLSINNDSLGLDLQAPIVSQNGKLALNVAGPLAVANGINALTVGTGKGIGLNETSTHLQAKLVAPLGFDTNGNIKLSVAGGMRLNNDTLILDVNYPFEAQGQLSLRVGQGPLYVDSSSHNLTIRCLRGLYITSSNNQTGLEANIKLTKGLVYDGNAIAVNVGQGLQYSTTATSEGVYPIQSKIGLGMEYDTNGAMMTKLGSGLSFDNSGAIVVGNKNDDRLTLWTTPDPSPNCRIYSEKDTKLTLVLTKCGSQILGTVSALAVRGSLAPITNASSIVQIFLRFDENGLLMSNSSLDGDYWNYRNGDSTNSTPYTNAVGFMPNLAAYPKGQATAAKSSIVSQVYMDGDTTKPITLKINFNGIDETTENTPVSKYSMTFSWSWPTASYIGHTFATNSFTFSYIAQE

SEQ ID NO: 21 - DNA, 37229 bp, Gorilla beringei beringei
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctaagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgagggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttaaagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtttccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagggccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggattaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgtgagaaggcgttgagcccgccctcgttccagacccggctgtagaccacgcccccctcggcgtcgcgagcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgttgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgagcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtaaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgtttatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgaggagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcacccagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgtcgtggccccgcgggcacgaaggcgcgcggccgctgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgtgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaaagtctagactctcacgctcgcttggtcctgtgactattttgtagaaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagatgaaccagctcaggcagcaatagctgaagatgaagaagaacttgaagaagaacaagctcaggacgaacaggcgcccactaagaaaacccatgtatacgcccaggcacctctttctggtgaaaaaattactaaggatggtttgcaaataggtgtggatgccacacaggcgggagataaccctatatatgctgataaaacattccaacccgaacctcagataggtgagtctcagtggaacgaggctgatgccacagtagcaggaggcagagtcttaaaaaagaccacccctatgagaccttgctatggatcctatgccaaacctactaatgccaatggcggtcaagggatcatggtggccaatgatcagggagcgcttgaatctaaagttgagatgcaatttttctccaccacaacgtctcttaatgtaagggaaggtgaaaacaatcttcagccaaaagtagtgctatacagcgaagatgttaacttggaatcccctgacactcatttgtcttacaaacctaaaaaggatgacaccaactctaaaatcatgttgggtcagcaagccatgcccaacagacccaacctcattgcttttagggacaactttattggacttatgtactacaacagcacaggcaacatgggagtgctggcaggacaggcctcccagctaaacgctgtggtagacttgcaagacagaaacacagagctgtcataccaactgatgcttgattccattggagacagatcaagatacttttccatgtggaaccaggcagtggacagctatgacccagatgtcagaatcattgaaaaccatggggttgaagatgagctgcccaactattgctttcccctgggcggtattggaattacagacacataccagtgcataaaaccaaccgcagctgctaataacactacatggtctaaggatgaagaatttagtgatcgcaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaaaaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttaaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaacggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtaccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggcgcgcttcttttttttcttgggagcggccgtgatggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccattgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtacccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtaccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgtggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagatctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagactttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcaaagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacgagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaatgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaatagccacaagcccagagccatctgcgatgggcaaaatctaaccttgattgatgttcaattgctggatgcgggctactattatgggcagctgggtacaatgattaattactggagaccccacagagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgaaaccaccgagatctgcttctgcaaatgctctgacgccattgcccaggatttggaagatcacgaggaagatgagcatgacttcgcagatgcatgccaggcatcagagccagaagcgctgccggtggccctcaaacagtatgcagacccccacaccacccccgaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccaaaagttcgccctcatgataggcgaacaacccatcaccgtgacccagcactccgtggagacagaaggctgcatacatgctccctgtaggggcgctgactgcctctacaccttgatcaaaaccctctgcggtctcagagaccttatccctttcaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagatctgcaggcacccattgtctctcaaaatggaaaactggctctaaatgtagcaggccccctagctgtggccaatggcattaatgctttgacagtaggcacaggcaaaggtattggtctaaatgaaaccagcactcacttgcaagcaaagttggtcgcccccctaggctttgataccaatggcaacattaagctaagcgttgcaggaggcatgagactaaataatgacacacttatactagatgtaaactacccatttgaagctcaaggccaactaagtctaagagtgggccagggtccgctgtatgtagattctagcagccataacctgaccattagatgccttagaggattatacataacatcgtctaataaccaaaccggtctagaggccaacataaaactaacaaaaggccttgtctatgatggaaatgccatagcagtcaatgttggtcaaggattgcaatacagcactactgccacatcggaaggtgtgtatcctatacagtctaagataggtttgggaatggaatatgataccaacggagccatgatgacaaaactaggctctggactaagctttgacaattcaggagccattgtagtgggaaacaaaaatgatgacaggcttactctgtggactacaccagacccatctcctaactgtagaatttattctgaaaaagatactaaactaaccttggtgctgactaagtgtggcagccaaatcctaggcacagtatctgcccttgctgtcagaggcagccttgcgcccatcactaatgcatccagcatagtccaaatatttctaagatttgatgaaaatggactattgatgagcaactcatcgctagacggtgattactggaattacagaaatggggactccactaatagcacaccatatacaaatgcagtaggctttatgcctaatctagcagcctatcctaaaggtcaggctacagctgcaaaaagcagtattgtaagccaggtatacatggatggtgacactactaaacctataacactaaaaataaacttcaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgttttgatttcaaaattgtgtgcttttatttattttcagcttacagtatttccagtagtcattcgaataaagcttaatcaaactgcatgagaacccttccacatagcttaaattagcaccagtgcaaatggagaaaattcaacataccttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaagcgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacgacaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatccttaggtaaatcaaatgacgacctctcataaacacgctggacatgtacatcacctccttgggcatgcgctgattcaccacctctcgataccacaagcatcgctgattaattaaagacccctcaagcaccatcctgaaccaggaagccagcacctgaccccccgccaggcactgcagggaccccggtgaattgcagtggcagtgaagactccagcgctcgtagccgtgaaccatagagccggtcattatatccacattggcacaacacaaacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagctcgcgtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccaggaaatgcattcactttgacagcgagagataggaggagcgggaagagatggaagaaccatgatagtaaaagacttttattccaatcgatcctctacaatgtcaaagtgtagatctataagatgacactggtctcctccgctgagtcgatcaaaaataacagctaaaccacaaacaacacgattggtcaaatgctccacaagggcttgcagcataaaatcgcctcgaaagtccaccgcaagcataacatcaaagccaccgcccctatcatgatctataataaaaaccccacagctatccaccagacccataaagttttcatctctccatcgtgaaaaaatatttacaagctcctcctttaaatcacctccaaccaattgaaaaagttgagccaaaccgccctccaccttcattttcagcaagcgcatcatgattgcaaaaattcaggctcctgagacacctgtataagattgagaagcggaacgttaacgtcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctgaccagcacggcccccaaataggcgtactgcataggcggcgacaaaaagtgaacagtttgggttaaaaaatcaggcaaacagtcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaacaaagaaagcggccaatgtacccaggaggaatcataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccggtttctcacggtacgtcacttccgcaagaaaagcaaaactacatttcccacatgtgtaaaaacgaaaccccgccccttgtaactgcccacaacttacatcatcaaaacataaactcctacgtcacccgccccgcctctccccgcccacctcattatcatattggccacaatccaaaataaggtatattattgatgatg

SEQ ID NO: 22 - DNA, 37232 bp, Gorilla beringei beringei
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctaagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgagggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttaaagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtttccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagggccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggattaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgtgagaaggcgttgagcccgccctcgttccagacccggctgtagaccacgcccccctcggcgtcgcgagcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgttgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgagcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtaaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgtttatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgaggagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcacccagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgtcgtggccccgcgggcacgaaggcgcgcggccgctgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgtgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaaataaaaaaaaagtctagactctcacgctcgcttggtcctgtgactattttgtagaaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagatgaaccagctcaggcagcaatagctgaagatgaagaagaacttgaagaagaacaagctcaggacgaacaggcgcccactaagaaaacccatgtatacgcccaggcacctctttctggtgaaaaaattactaaggatggtttgcaaataggtgtggatgccacacaggcgggagataaccctatatatgctgataaaacattccaacccgaacctcagataggtgagtctcagtggaacgaggctgatgccacagtagcaggaggcagagtcttaaaaaagaccacccctatgagaccttgctatggatcctatgccaaacctactaatgccaatggcggtcaagggatcatggtggccaatgatcagggagcgcttgaatctaaagttgagatgcaatttttctccaccacaacgtctcttaatgtaagggaaggtgaaaacaatcttcagccaaaagtagtgctatacagcgaagatgttaacttggaatcccctgacactcatttgtcttacaaacctaaaaaggatgacaccaactctaaaatcatgttgggtcagcaagccatgcccaacagacccaacctcattgcttttagggacaactttattggacttatgtactacaacagcacaggcaacatgggagtgctggcaggacaggcctcccagctaaacgctgtggtagacttgcaagacagaaacacagagctgtcataccaactgatgcttgattccattggagacagatcaagatacttttccatgtggaaccaggcagtggacagctatgacccagatgtcagaatcattgaaaaccatggggttgaagatgagctgcccaactattgctttcccctgggcggtattggaattacagacacataccagtgcataaaaccaaccgcagctgctaataacactacatggtctaaggatgaagaatttagtgatcgcaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaaaaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttaaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaacggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtaccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggcgcgcttcttttttttcttgggagcggccgtgatggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccattgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtacccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtaccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgtggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagatctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagactttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcaaagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacgagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaatgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaatagccacaagcccagagccatctgcgatgggcaaaatctaaccttgattgatgttcaattgctggatgcgggctactattatgggcagctgggtacaatgattaattactggagaccccacagagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgaaaccaccgagatctgcttctgcaaatgctctgacgccattgcccaggatttggaagatcacgaggaagatgagcatgacttcgcagatgcatgccaggcatcagagccagaagcgctgccggtggccctcaaacagtatgcagacccccacaccacccccgaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccaaaagttcgccctcatgataggcgaacaacccatcaccgtgacccagcactccgtggagacagaaggctgcatacatgctccctgtaggggcgctgactgcctctacaccttgatcaaaaccctctgcggtctcagagaccttatccctttcaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagatctgcaggcacccattgtctctcaaaatggaaaactggctctaaatgtagcaggccccctagctgtggccaatggcattaatgctttgacagtaggcacaggcaaaggtattggtctaaatgaaaccagcactcacttgcaagcaaagttggtcgcccccctaggctttgataccaatggcaacattaagctaagcgttgcaggaggcatgagactaaataatgacacacttatactagatgtaaactacccatttgaagctcaaggccaactaagtctaagagtgggccagggtccgctgtatgtagattctagcagccataacctgaccattagatgccttagaggattatacataacatcgtctaataaccaaaccggtctagaggccaacataaaactaacaaaaggccttgtctatgatggaaatgccatagcagtcaatgttggtcaaggattgcaatacagcactactgccacatcggaaggtgtgtatcctatacagtctaagataggtttgggaatggaatatgataccaacggagccatgatgacaaaactaggctctggactaagctttgacaattcaggagccattgtagtgggaaacaaaaatgatgacaggcttactctgtggactacaccagacccatctcctaactgtagaatttattctgaaaaagatactaaactaaccttggtgctgactaagtgtggcagccaaatcctaggcacagtatctgcccttgctgtcagaggcagccttgcgcccatcactaatgcatccagcatagtccaaatatttctaagatttgatgaaaatggactattgatgagcaactcatcgctagacggtgattactggaattacagaaatggggactccactaatagcacaccatatacaaatgcagtaggctttatgcctaatctagcagcctatcctaaaggtcaggctacagctgcaaaaagcagtattgtaagccaggtatacatggatggtgacactactaaacctataacactaaaaataaacttcaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgttttgatttcaaaattgtgtgcttttatttattttcagcttacagtatttccagtagtcattcgaataaagcttaatcaaactgcatgagaacccttccacatagcttaaattagcaccagtgcaaatggagaaaattcaacataccttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaagcgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacgacaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatccttaggtaaatcaaatgacgacctctcataaacacgctggacatgtacatcacctccttgggcatgcgctgattcaccacctctcgataccacaagcatcgctgattaattaaagacccctcaagcaccatcctgaaccaggaagccagcacctgaccccccgccaggcactgcagggaccccggtgaattgcagtggcagtgaagactccagcgctcgtagccgtgaaccatagagccggtcattatatccacattggcacaacacaaacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagctcgcgtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccaggaaatgcattcactttgacagcgagagataggaggagcgggaagagatggaagaaccatgatagtaaaagacttttattccaatcgatcctctacaatgtcaaagtgtagatctataagatgacactggtctcctccgctgagtcgatcaaaaataacagctaaaccacaaacaacacgattggtcaaatgctccacaagggcttgcagcataaaatcgcctcgaaagtccaccgcaagcataacatcaaagccaccgcccctatcatgatctataataaaaaccccacagctatccaccagacccataaagttttcatctctccatcgtgaaaaaatatttacaagctcctcctttaaatcacctccaaccaattgaaaaagttgagccaaaccgccctccaccttcattttcagcaagcgcatcatgattgcaaaaattcaggctcctgagacacctgtataagattgagaagcggaacgttaacgtcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctgaccagcacggcccccaaataggcgtactgcataggcggcgacaaaaagtgaacagtttgggttaaaaaatcaggcaaacagtcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaacaaagaaagcggccaatgtacccaggaggaatcataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccggtttctcacggtacgtcacttccgcaagaaaagcaaaactacatttcccacatgtgtaaaaacgaaaccccgccccttgtaactgcccacaacttacatcatcaaaacataaactcctacgtcacccgccccgcctctccccgcccacctcattatcatattggccacaatccaaaataaggtatattattgatgatg

SEQ ID NO: 23 - DNA, 37213 bp, Gorilla beringei beringei
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctaagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgagggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttaaagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtttccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagggccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggattaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgtgagaaggcgttgagcccgccctcgttccagacccggctgtagaccacgcccccctcggcgtcgcgagcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgttgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgagcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtaaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgtttatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgaggagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcacccagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgtcgtggccccgcgggcacgaaggcgcgcggccgctgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgtgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaaagtctagactctcacgctcgcttggtcctgtgactattttgtagaaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagatgaaccagctcaggcagcaatagctgaagatgaagaagaacttgaagaagaacaagctcaggacgaacaggcgcccactaagaaaacccatgtatacgcccaggcacctctttctggtgaaaaaattactaaggatggtttgcaaataggtgtggatgccacacaggcgggagataaccctatatatgctgataaaacattccaacccgaacctcagataggtgagtctcagtggaacgaggctgatgccacagtagcaggaggcagagtcttaaaaaagaccacccctatgagaccttgctatggatcctatgccaaacctactaatgccaatggcggtcaagggatcatggtggccaatgatcagggagcgcttgaatctaaagttgagatgcaatttttctccaccacaacgtctcttaatgtaagggaaggtgaaaacaatcttcagccaaaagtagtgctatacagcgaagatgttaacttggaatcccctgacactcatttgtcttacaaacctaaaaaggatgacaccaactctaaaatcatgttgggtcagcaagccatgcccaacagacccaacctcattgcttttagggacaactttattggacttatgtactacaacagcacaggcaacatgggagtgctggcaggacaggcctcccagctaaacgctgtggtagacttgcaagacagaaacacagagctgtcataccaactgatgcttgattccattggagacagatcaagatacttttccatgtggaaccaggcagtggacagctatgacccagatgtcagaatcattgaaaaccatggggttgaagatgagctgcccaactattgctttcccctgggcggtattggaattacagacacataccagtgcataaaaccaaccgcagctgctaataacactacatggtctaaggatgaagaatttagtgatcgcaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaaaaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttaaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaacggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtaccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggcgcgcttcttttttttcttgggagcggccgtgatggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccattgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtacccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtaccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgtggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagatctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagactttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcaaagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacgagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaatgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaatagccacaagcccagagccatctgcgatgggcaaaatctaaccttgattgatgttcaattgctggatgcgggctactattatgggcagctgggtacaatgattaattactggagaccccacagagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgaaaccaccgagatctgcttctgcaaatgctctgacgccattgcccaggatttggaagatcacgaggaagatgagcatgacttcgcagatgcatgccaggcatcagagccagaagcgctgccggtggccctcaaacagtatgcagacccccacaccacccccgaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccaaaagttcgccctcatgataggcgaacaacccatcaccgtgacccagcactccgtggagacagaaggctgcatacatgctccctgtaggggcgctgactgcctctacaccttgatcaaaaccctctgcggtctcagagaccttatccctttcaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagatctgcaggcacccattgtctctcaaaatggaaaactggctctaaatgtagcaggccccctagctgtggccaatggcattaatgctttgacagtaggcacaggcaaaggtattggtctaaatgaaaccagcactcacttgcaagcaaagttggtcgcccccctaggctttgataccaatggcaacattaagctaagcgttgcaggaggcatgagactaaataatgacacacttatactagatgtaaactacccatttgaagctcaaggccaactaagtctaagagtgggccagggtccgctgtatgtagattctagcagccataacctgaccattagatgccttagaggattatacataacatcgtctaataaccaaaccggtctagaggccaacataaaactaacaaaaggccttgtctatgatggaaatgccatagcagtcaatgttggtcaaggattgcaatacagcactactgccacatcggaaggtgtgtatcctatacagtctaagataggtttgggaatggaatatgataccaacggagccatgatgacaaaactaggctctggactaagctttgacaattcaggagccattgtagtgggaaacaaaaatgatgacaggcttactctgtggactacaccagacccatctcctaactgtagaatttattctgaaaaagatactaaactaaccttggtgctgactaagtgtggcagccaaatcctaggcacagtatctgcccttgctgtcagaggcagccttgcgcccatcactaatgcatccagcatagtccaaatatttctaagatttgatgaaaatggactattgatgagcaactcatcgctagacggtgattactggaattacagaaatggggactccactaatagcacaccatatacaaatgcagtaggctttatgcctaatctagcagcctatcctaaaggtcaggctacagctgcaaaaagcagtattgtaagccaggtatacatggatggtgacactactaaacctataacactaaaaataaacttcaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgttttgatttcaaaattgtgtgcttttatttattttcagcttacagtatttccagtagtcattcgaataaagcttaatcaaactgcatgagaacccttccacatagcttaaattagcaccagtgcaaatggagaaaattcaacataccttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaagcgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacgacaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatccttaggtaaatcaaatgacgacctctcataaacacgctggacatgtacatcacctccttgggcatgcgctgattcaccacctctcgataccacaagcatcgctgattaattaaagacccctcaagcaccatcctgaaccaggaagccagcacctgaccccccgccaggcactgcagggaccccggtgaattgcagtggcagtgaagactccagcgctcgtagccgtgaaccatagagccggtcattatatccacattggcacaacacaaacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagctcgcgtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccaggaaatgcattcactttgacagcgagagataggaggagcgggaagagatggaagaaccatgatagtaaaagacttttattccaatcgatcctctacaatgtcaaagtgtagatctataagatgacactggtctcctccgctgagtcgatcaaaaataacagctaaaccacaaacaacacgattggtcaaatgctccacaagggcttgcagcataaaatcgcctcgaaagtccaccgcaagcataacatcaaagccaccgcccctatcatgatctataataaaaaccccacagctatccaccagacccataaagttttcatctctccatcgtgaaaaaatatttacaagctcctcctttaaatcacctccaaccaattgaaaaagttgagccaaaccgccctccaccttcattttcagcaagcgcatcatgattgcaaaaattcaggctcctgagacacctgtataagattgagaagcggaacgttaacgtcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctgaccagcacggcccccaaataggcgtactgcataggcggcgacaaaaagtgaacagtttgggttaaaaaatcaggcaaacagtcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaacaaagaaagcggccaatgtacccaggaggaatcataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccggtttctcacggtacgtcacttccgcaagaaaagcaaaactacatttcccacatgtgtaaaaacgaaaccccgccccttgtaactgcccacaacttacatcatcaaaacataaactcctacgtcacccgccccgcctctccccgcccacctcattatcatattggccacaatccaaaataaggtatattat

SEQ ID NO: 24 - DNA, 37216 bp, Gorilla beringei beringei
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctaagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgagggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttaaagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtttccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagggccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggattaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgtgagaaggcgttgagcccgccctcgttccagacccggctgtagaccacgcccccctcggcgtcgcgagcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgttgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgagcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtaaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgtttatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgaggagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcacccagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgtcgtggccccgcgggcacgaaggcgcgcggccgctgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgtgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaaataaaaaaaaagtctagactctcacgctcgcttggtcctgtgactattttgtagaaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagatgaaccagctcaggcagcaatagctgaagatgaagaagaacttgaagaagaacaagctcaggacgaacaggcgcccactaagaaaacccatgtatacgcccaggcacctctttctggtgaaaaaattactaaggatggtttgcaaataggtgtggatgccacacaggcgggagataaccctatatatgctgataaaacattccaacccgaacctcagataggtgagtctcagtggaacgaggctgatgccacagtagcaggaggcagagtcttaaaaaagaccacccctatgagaccttgctatggatcctatgccaaacctactaatgccaatggcggtcaagggatcatggtggccaatgatcagggagcgcttgaatctaaagttgagatgcaatttttctccaccacaacgtctcttaatgtaagggaaggtgaaaacaatcttcagccaaaagtagtgctatacagcgaagatgttaacttggaatcccctgacactcatttgtcttacaaacctaaaaaggatgacaccaactctaaaatcatgttgggtcagcaagccatgcccaacagacccaacctcattgcttttagggacaactttattggacttatgtactacaacagcacaggcaacatgggagtgctggcaggacaggcctcccagctaaacgctgtggtagacttgcaagacagaaacacagagctgtcataccaactgatgcttgattccattggagacagatcaagatacttttccatgtggaaccaggcagtggacagctatgacccagatgtcagaatcattgaaaaccatggggttgaagatgagctgcccaactattgctttcccctgggcggtattggaattacagacacataccagtgcataaaaccaaccgcagctgctaataacactacatggtctaaggatgaagaatttagtgatcgcaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaaaaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttaaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaacggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtaccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggcgcgcttcttttttttcttgggagcggccgtgatggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccattgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtacccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtaccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgtggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagatctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagactttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcaaagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacgagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaatgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaatagccacaagcccagagccatctgcgatgggcaaaatctaaccttgattgatgttcaattgctggatgcgggctactattatgggcagctgggtacaatgattaattactggagaccccacagagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgaaaccaccgagatctgcttctgcaaatgctctgacgccattgcccaggatttggaagatcacgaggaagatgagcatgacttcgcagatgcatgccaggcatcagagccagaagcgctgccggtggccctcaaacagtatgcagacccccacaccacccccgaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccaaaagttcgccctcatgataggcgaacaacccatcaccgtgacccagcactccgtggagacagaaggctgcatacatgctccctgtaggggcgctgactgcctctacaccttgatcaaaaccctctgcggtctcagagaccttatccctttcaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagatctgcaggcacccattgtctctcaaaatggaaaactggctctaaatgtagcaggccccctagctgtggccaatggcattaatgctttgacagtaggcacaggcaaaggtattggtctaaatgaaaccagcactcacttgcaagcaaagttggtcgcccccctaggctttgataccaatggcaacattaagctaagcgttgcaggaggcatgagactaaataatgacacacttatactagatgtaaactacccatttgaagctcaaggccaactaagtctaagagtgggccagggtccgctgtatgtagattctagcagccataacctgaccattagatgccttagaggattatacataacatcgtctaataaccaaaccggtctagaggccaacataaaactaacaaaaggccttgtctatgatggaaatgccatagcagtcaatgttggtcaaggattgcaatacagcactactgccacatcggaaggtgtgtatcctatacagtctaagataggtttgggaatggaatatgataccaacggagccatgatgacaaaactaggctctggactaagctttgacaattcaggagccattgtagtgggaaacaaaaatgatgacaggcttactctgtggactacaccagacccatctcctaactgtagaatttattctgaaaaagatactaaactaaccttggtgctgactaagtgtggcagccaaatcctaggcacagtatctgcccttgctgtcagaggcagccttgcgcccatcactaatgcatccagcatagtccaaatatttctaagatttgatgaaaatggactattgatgagcaactcatcgctagacggtgattactggaattacagaaatggggactccactaatagcacaccatatacaaatgcagtaggctttatgcctaatctagcagcctatcctaaaggtcaggctacagctgcaaaaagcagtattgtaagccaggtatacatggatggtgacactactaaacctataacactaaaaataaacttcaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgttttgatttcaaaattgtgtgcttttatttattttcagcttacagtatttccagtagtcattcgaataaagcttaatcaaactgcatgagaacccttccacatagcttaaattagcaccagtgcaaatggagaaaattcaacataccttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaagcgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacgacaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatccttaggtaaatcaaatgacgacctctcataaacacgctggacatgtacatcacctccttgggcatgcgctgattcaccacctctcgataccacaagcatcgctgattaattaaagacccctcaagcaccatcctgaaccaggaagccagcacctgaccccccgccaggcactgcagggaccccggtgaattgcagtggcagtgaagactccagcgctcgtagccgtgaaccatagagccggtcattatatccacattggcacaacacaaacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagctcgcgtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgctcggtgtagtagttgtaatacagccactccctcagaccgtcaaggcgctccctggcgtccggatctataacaacaccgtcctgcagcgccgccctgatgacatccaccaccgtagagtatgccaagcccagccaggaaatgcattcactttgacagcgagagataggaggagcgggaagagatggaagaaccatgatagtaaaagacttttattccaatcgatcctctacaatgtcaaagtgtagatctataagatgacactggtctcctccgctgagtcgatcaaaaataacagctaaaccacaaacaacacgattggtcaaatgctccacaagggcttgcagcataaaatcgcctcgaaagtccaccgcaagcataacatcaaagccaccgcccctatcatgatctataataaaaaccccacagctatccaccagacccataaagttttcatctctccatcgtgaaaaaatatttacaagctcctcctttaaatcacctccaaccaattgaaaaagttgagccaaaccgccctccaccttcattttcagcaagcgcatcatgattgcaaaaattcaggctcctgagacacctgtataagattgagaagcggaacgttaacgtcaatgtttcgctcgcgaagatcgcgcctcagtgcaagcatgatataatcccacaggtcggagcggatcagcgaggacatctccccgccaggaaccaactcaacggagcctatgctgattataatacgcatattcggggctatgctgaccagcacggcccccaaataggcgtactgcataggcggcgacaaaaagtgaacagtttgggttaaaaaatcaggcaaacagtcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaacaaagaaagcggccaatgtacccaggaggaatcataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccggtttctcacggtacgtcacttccgcaagaaaagcaaaactacatttcccacatgtgtaaaaacgaaaccccgccccttgtaactgcccacaacttacatcatcaaaacataaactcctacgtcacccgccccgcctctccccgcccacctcattatcatattggccacaatccaaaataaggtatattat

SEQ ID NO: 25 - DNA, 1722 bp, ARTIFICIAL SEQUENCE
  Synthetic
atggagctgctgatcctgaaggccaacgccatcaccaccatcctgaccgccgtgaccttctgcttcgccagcggccagaatatcaccgaggagttctaccagagcacctgtagcgccgtgtccaagggctacctgagcgccctgagaaccggctggtacaccagcgtgatcaccatcgagctgtccaacatcaaggaaaacaagtgtaacggcaccgacgccaaggtgaagctgatcaagcaggagctggacaagtacaagaacgccgtgaccgagctgcagctgctgatgcagagcacccccgccaccaacaacagagccaggcgcgagctgccccggttcatgaactacaccctgaacaacgccaagaaaaccaacgtgaccctgagcaagaagcggaagcggagattcctgggcttcctgctgggagtgggcagcgccatcgccagcggagtggccgtgtctaaggtgctgcacctggagggcgaggtgaacaagatcaagagcgccctgctgtccaccaacaaggccgtggtgtccctgagcaacggcgtgtccgtgctgaccagcaaggtgctggatctgaagaactacatcgacaagcagctgctgcccatcgtgaacaagcagagctgctccatcagcaacatcgagaccgtgatcgagttccagcagaagaacaaccggctgctggagatcaccagggagttcagcgtgaacgccggcgtgaccacccctgtgagcacctacatgctgaccaacagcgagctgctgtccctgatcaatgacatgcccatcaccaacgaccagaaaaagctgatgagcaacaacgtgcagattgtgaggcagcagagctacagcatcatgagcatcatcaaggaagaggtgctggcctacgtggtgcagctgcccctgtacggcgtgatcgataccccttgctggaagctgcacaccagccctctgtgtaccaccaacaccaaggagggcagcaacatctgcctgaccaggaccgatagaggctggtactgtgacaatgccggcagcgtgtccttcttcccccaggccgagacctgtaaggtgcagagcaaccgggtgttctgtgacaccatgaacagcctgaccctgcccagcgaggtgaacctgtgtaacgtggacatcttcaaccccaagtacgactgtaagatcatgacctccaagaccgacgtgtccagcagcgtgattaccagcctgggcgccatcgtgtcctgctacggcaagaccaagtgtaccgccagcaacaagaaccgggggatcatcaagaccttcagcaacggctgtgactacgtgtccaacaagggcgtggacaccgtgtctgtgggcaacacactgtactacgtgaataagcaggagggcaagagcctgtacgtgaagggcgagcccatcatcaacttctacgaccccctggtgttccctagcgacgagttcgatgccagcatcagccaggtgaacgagaagatcaaccagagcctggccttcatcaggaagagcgacgagctgctgcacaatgtgaatgccggcaagagcaccaccaacatcatgatcaccacaatcatcatcgtgatcattgtgatcctgctgtctctgattgctgtgggcctgctgctgtactgtaaggccagatccacccccgtgaccctgtccaaggaccagctgtccggcatcaacaacatcgccttctccaac

SEQ ID NO: 26 - protein, 574 aa, ARTIFICIAL SEQUENCE
  Synthetic
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 27 - DNA, 28 bp, Gorilla beringei graueri
ccccgttctgccttcaaattcgtctaca

SEQ ID NO: 28 - DNA, 1284 bp, Gorilla beringei graueri
ccttccgcgccgagcgcccccagcgcaccaacctcgggcccaacatgctggccccctcccacgagctctatgactacgtgcgcgccagcatccgcggggggcgctgctaccccacctacctcggcatcctcagggaacccctgtacgtgtatgacatctgcggcatgtacgcctccgcgctcacccaccccatgccctggggcccgcccctcaacccctacgagcgcgcgctcgccgcccgcgaatggcagcgggctctggacatgcaagcttgcaagatcgactactttgacccgcgcttgctccccggggtcttcaccatcgacgcggaccccccaaacgaggaccagctggaccccctaccccccttctgctcgcgcaagggcggccgcctctgctggaccaacgagcgcctgcgcggcgaggtcgccaccagcgtcgacatggtcaccctgcacaaccgaggctggagggtgcgcctgatcccagacgagcgcaccaccgtcttccccgagtggaagtgcgtggcccgcgagtacgtgcaactcaacatcgcggccaaggagcgagccgaccgcgacaaaaaccagaccctgcgctccatcgccaagctgctctccaacgccctctacgggtcgttcgccaccaagcttgacaacaaaaaaatagtgttttctgaccagatggacccaggtaccctcaaaggtatcacctcaggacaggtgaacatcaaatcctcctcatttttagaaactgacaacctgagcgctgaggtcatgcccgccttcgagagggaatacttaccccagcagctggctctcgcagacagcgatgcggaagagagtgaagatgaaagggcgcccacccccttttatacccccccgtcgggaacccccggtcacgtgtcctacacctacaagccaatcacttttctggacgcggaggagggggacatgtgcctgcacaccctggagaaggtggacccgctagtggacaacgaccgctacccctcccacgtggcctccttcgtcctggcctggacgcgggccttcgtctcagagtggtcagagtttctctacgaggaggacagaggcactccgctggaagacaggcccctgaagtcggtctacggggacacggacagcctcttcgtcaccgagaagggacaccgcctcatggagagccgaggtaagaaacgcatcaaaaagcatgggggcaacctggtttttgaccctgaccgcccggagctcacttggctggtggaatgcgagacggtctgcgctt

SEQ ID NO: 29 - DNA, 45 bp, Gorilla beringei graueri
gaggcggcggcggtagcgaccgcagagccggagaccgtagaggag

SEQ ID NO: 30 - DNA, 48 bp, Gorilla beringei graueri
actaatactgctgaagcagccattgaaaatgaagaagagctggcggat

SEQ ID NO: 31 - DNA, 48 bp, Gorilla beringei graueri
tcatggaggtggacaaatggagactacgtggggcactattttaaaaca

SEQ ID NO: 32 - DNA, 399 bp, Gorilla beringei graueri
atgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccc

SEQ ID NO: 33 - DNA, 399 bp, Gorilla beringei graueri
atgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccc

SEQ ID NO: 34 - DNA, 399 bp, Gorilla beringei graueri
atgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccc

SEQ ID NO: 35 - DNA, 3168 bp, Gorilla beringei graueri
atggacagctccaatgtgcgcgatgtcgtcatcaaactccgcccgccgagcgccgagatctggacctgcggctctcgcggcgtggtggtctgctccaccatcgccctccaggagacagatgctggcggccagacaaccaaagtagaagaccaccagccacacgggaccccaggcgggggacttagattcccgctgcgcttcctcgtcagaggtcgccaggttcacctcgtgcaagatatacaacccgtgcagcgctgccagtactgcggtcgcttttacaaaagccagcacgagtgctcggcccgcagacgggacttctactttcaccacatcaacagccaatcctccaactggtggcgggagatccagttcttcccgatcggctctcatcctcgcacggagcgcctctttgtcacctacgatgtagagacctacacttggatgggagcctttggcaagcagctcgtgcccttcatgctggtcatgaaactggggggcgacgaggctctggtcgccgccgcgcgcgacctcgcccgagagctcagatgggacccctgggagaaagaccccctcaccttctactgcatcacccccgaaaagatggccgtggggcgacagttcagaaccttccgcgaccgcctgcagaccctcatggcccgcgacctctggcgatccttcctggcggccaaccctcacttgcaagactgggccctggaggagcacggcctggaatcgcccgaggagctcacctacgaggaactcaaaaagctcccctccatcaagggccagccccgctttttggagctctacatcgtgggccacaacataaacggctttgacgagatcgtcctggccgcccaggtcatcaacaaccgctcctcggtcccagggccctttcgcatcaccagaaacttcatgcctcgagcggggaagatcctcttcaatgacctcaccttctccctgcccaacccgcgctccaaaaagcgcacggactacaccctgtgggaacagggcggctgcgatgacacagacttcaaacatcaatacctcaaagtcatggtcagggacactttcgccctcacccacacctccctccgcaaggcggcgcaggcctacgcgctgcccgtggagaagggctgttgcccctaccaggccgtcaaccagttctacatgctaggctcttaccgttcggacacggacgggtttcccctccaagagtactggaaagaccgcgaagagttcgtcctcaaccgcgagctgtggaaaaagaagggggaggataagtatgacatcatccgcgagaccctcgactactgcgcgctcgacgtccaggtcaccgccgagctggtgcacaagctgcgcgagtcctacgcctccttcgtcagggactcggtgggcttgcaagaagcaagcttcaacgtcttccagcggcccaccatctcctccaactcccatgccatcttcaggcagatcgccttccgcgccgagcgcccccagcgcaccaacctcgggcccaacatgctggccccctcccacgagctctatgactacgtgcgcgccagcatccgcggggggcgctgctaccccacctacctcggcatcctcagggaacccctgtacgtgtatgacatctgcggcatgtacgcctccgcgctcacccaccccatgccctggggcccgcccctcaacccctacgagcgcgcgctcgccgcccgcgaatggcagcgggctctggacatgcaagcttgcaagatcgactactttgacccgcgcttgctccccggggtcttcaccatcgacgcggaccccccaaacgaggaccagctggaccccctaccccccttctgctcgcgcaagggcggccgcctctgctggaccaacgagcgcctgcgcggcgaggtcgccaccagcgtcgacatggtcaccctgcacaaccgaggctggagggtgcgcctgatcccagacgagcgcaccaccgtcttccccgagtggaagtgcgtggcccgcgagtacgtgcaactcaacatcgcggccaaggagcgagccgaccgcgacaaaaaccagaccctgcgctccatcgccaagctgctctccaacgccctctacgggtcgttcgccaccaagcttgacaacaaaaaaatagtgttttctgaccagatggacccaggtaccctcaaaggtatcacctcaggacaggtgaacatcaaatcctcctcatttttagaaactgacaacctgagcgctgaggtcatgcccgccttcgagagggaatacttaccccagcagctggctctcgcagacagcgatgcggaagagagtgaagatgaaagggcgcccacccccttttatacccccccgtcgggaacccccggtcacgtgtcctacacctacaagccaatcacttttctggacgcggaggagggggacatgtgcctgcacaccctggagaaggtggacccgctagtggacaacgaccgctacccctcccacgtggcctccttcgtcctggcctggacgcgggccttcgtctcagagtggtcagagtttctctacgaggaggacagaggcactccgctggaagacaggcccctgaagtcggtctacggggacacggacagcctcttcgtcaccgagaagggacaccgcctcatggagagccgaggtaagaaacgcatcaaaaagcatgggggcaacctggtttttgaccctgaccgcccggagctcacttggctggtggaatgcgagacggtctgcgcttcctgcggcgcggacgcctactccccagagtccgtgtttctcgctcccaagctctacgccctgaagagcctgcagtgcccctcgtgcggcgccacctccaagggaaagctccgcgccaaggggcacgccgccgagggtctcgactacgagaccatggtcaaatgctacctggccgacgcgcagggcgaagagcggcagcgattcagcaccagcagaaccagcctcaagcgcaccctggccagcgcccaacccggagcgcaccccttcaccgtgacccagaccaccctgacgaggaccctgcgcccatggaaggacatgactctggccccgctggacgcccatcggctggtgccctacagcgaaagccgccccaacccgcgaaacgaggagatctgctggatcgagatgccg

SEQ ID NO: 36 - DNA, 1863 bp, Gorilla beringei graueri
atgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttt

SEQ ID NO: 37 - DNA, 2841 bp, Gorilla beringei graueri
atggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacc

SEQ ID NO: 38 - DNA, 1740 bp, Gorilla beringei graueri
atgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaa

SEQ ID NO: 39 - protein, 429 aa, Gorilla beringei graueri
AFRAERPQRTNLGPNMLAPSHELYDYVRASIRGGRCYPTYLGILREPLYVYDICGMYASALTHPMPWGPPLNPYERALAAREWQRALDMQACKIDYFDPRLLPGVFTIDADPPNEDQLDPLPPFCSRKGGRLCWTNERLRGEVATSVDMVTLHNRGWRVRLIPDERTTVFPEWKCVAREYVQLNIAAKERADRDKNQTLRSIAKLLSNALYGSFATKLDNKKIVFSDQMDPGTLKGITSGQVNIKSSSFLETDNLSAEVMPAFEREYLPQQLALADSDAEESEDERAPTPFYTPPSGTPGHVSYTYKPITFLDAEEGDMCLHTLEKVDPLVDNDRYPSHVASFVLAWTRAFVSEWSEFLYEEDRGTPLEDRPLKSVYGDTDSLFVTEKGHRLMESRGKKRIKKHGGNLVFDPDRPELTWLVECETVCAS

SEQ ID NO: 40 - protein, 15 aa, Gorilla beringei graueri
EAAAVATAEPETVEE

SEQ ID NO: 41 - protein, 16 aa, Gorilla beringei graueri
TNTAEAAIENEEELAD

SEQ ID NO: 42 - protein, 16 aa, Gorilla beringei graueri
SWRWTNGDYVGHYFKT

SEQ ID NO: 43 - protein, 133 aa, Gorilla beringei graueri
MSDTGNSFDGSIFSPYLTVRMPHWAGVRQNVMGSNVDGRPVLPSNSSTMAYATVGGTPLDAATSAAASAAAATARSMATDLYSSLVASSAASRASARDEKLTALLLKLEDLTRELGQLTQQVSSLRESSLASP

SEQ ID NO: 44 - protein, 133 aa, Gorilla beringei graueri
MSDTGNSFDGSIFSPYLTVRMPHWAGVRQNVMGSNVDGRPVLPSNSSTMAYATVGGTPLDAATSAAASAAAATARSMATDLYSSLVASGAASRASARDEKLTALLLKLEDLTRELAQLTQQVSSLRESSLASP

SEQ ID NO: 45 - protein, 1056 aa, Gorilla beringei graueri; identical to SEQ ID NO: 17

SEQ ID NO: 46 - protein, 621 aa, Gorilla beringei graueri
MRRAAMFEEGPPPSYESAMGFSPATPLQPPYVPPRYLQPTGGRNSICYSELQPLYDTTKVYLVDNKSADVASLNYQNDHSDFLTTVIQNNDFTPNEASTQTINLDNRSHWGGDLKTILHTNMPNVNEFMFTNSFKARVMVARDDKGVPKYEWVDFTLPEGNYSEIMTLDLMNNAIVEHYLKVGRQNGVKESDIGVKFDTRNFRLGWDPETGLVMPGVYTNEAFHPDIVLLPGCGVDFTQSRLSNLLGIRKRQPFQEGFQITYEHLEGGNIPALLDLVAYEESLKSEESGDNTDKGGEEQAGDGDTASVENESASVVEAAAVATAEPETVEEDMNDSAIRGDSFIPRGEEKKAEAAAAVEAEPKVESEIMEEDLNDNAIRGDTFVPRGEEKKAEAEAAAEEAAEAVAATAAVTETTEEQVQAEQVQKKPVIKALTQDSKERSYNLIPGSTDTEYRSWYLAYNYGDPVKGVRSWTLLCTPDVTCGSEQMYWSLPNMMQDPVTFRSTRQVNNFPVVGAELLPVHSKSFYNEQAVYSQLIRQATSLTHVFNRFPENQILARPPAPTITTVSENVPALTDHGTLPLRNSISGVQRVTITDARRRTCPYVYKALGIVSPRVLSSRTF

SEQ ID NO: 47 - protein, 947 aa, Gorilla beringei graueri
MATPSMMPQWSYMHISGQDASEYLSPGLVQFARATDSYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWDEKTNTAEAAIENEEELADEPEEQAEEAIKTNVFAQAPYSGNAISKEGIQVGIEGIGEQVKAVYADKTYQPEPQVGETQWNETEINHGAGRVLKKTTPMKPCYGSYAKPTNEYGGQGILVEKNGKMESQVETQFFALDGENDNSPKVVLYSEDVNLDTPDTHLSYKPSAQDVNSKEMLGQQAMPNRPNLIAFRDNFIGLMYYNSTGNMGVLAGQASQLNAVVDLQDRNTELSYQLMLDSIGDRSRYFAMWNQAVDSYDPDVRIIENHGTEDELPNYCFPLGGIFNTQSFKKVKPGTDNGWETDDDFSDKNEIRVGNNFAMEINIQANLWRSFLYSNVALYLPDKMKYSPTNIDISTNTNTYDYMNKRVAPPGLVDCYVNLGARWSLDVMDNMNPFNHHRNAGLRYRSMLLGNGRYVPFHIQVPQKFFAIKSLLLLPGSYTYEWNFRKDVNMVLQSSLGNDLRVDGASIKFDSITLYATFFPMAHNTASTLEAMLRNDTNDQSFNDYLSGANMLYPIPANATNVPISIPSRNWAAFRGWAFTRLKTKETPSLGSGFDPYFVYSGSIPYLDGTFYLNHTFKKISIMYDSSVSWPGNDRLLTPNEFEVKRAVDGEGYNVAQCNMTKDWFLVQMLANYNIGYQGFYIPESYKDRMYSFFRNFQPMSRQVVDETKYKDYQAVGITHQHNNSGFVGYLAPTMREGQAYPANFPYPLIGKTAVDSVTQKKFLCDRTLWRIPFSSNFMSMGALTDLGQNLLYANSAHALDMTFEVDPMDEPTLLYIVFEVFDVVRVHQPHRGVIETVYLRTPFSAGNATT

SEQ ID NO: 48 - protein, 580 aa, Gorilla beringei graueri
MKRARSSDETFNPVYPYDTEIAPTSVPFPTPPFVSPAGMQENPPGVLSLRLAEPLTTSNGALTLKMGGGLTLDEEGKLTSQNITSVDPPLKKTKNNISLQTASPLAVSSGALTLFATPPLAVNDNNLTVQSQAPLTLENSKLSLATKGPLTVSEGKLALETEAPLHASDSSSLGLSVTAPLSISSDSLGLDLQAPIISENGKLGLRVTGPLTVASSIDALTVATGSGIGLDSNTRLQAKLVAPLGFDTNGNIKLSTSGGMRLNNGTLILDVNYPFEAQGQLSLRVGSGPLYVDSNTHNLTARCLRGLYITSSNNQTGLEANIKLTKGLVFDGNAIAVNVSKGLEYSTTETAQGVNPIQTKIGLGMEYDTNGAIKPRLGSGLSFDNSGAIVVGNKNDDTLTLWTTPDPSPNCQINSEKDAKLTLVLTKCGSQIVGTVSAFALKGSLAPINGTVSSVSIFLRFNENGVLMSNSSLESQYWNYRNGNSTNATPYTNALGFMPNLAAYPKGQATTAKSSIISQVYMNGDTSKPMIFTITFNGLETEETQVSTYSMTFSWRWTNGDYVGHYFKTNSFTFSYIAQE

SEQ ID NO: 49 - DNA, 37073 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 50 - DNA, 37074 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 51 - DNA, 37073 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 52 - DNA, 37074 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 53 - DNA, 37073 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 54 - DNA, 37074 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 55 - DNA, 37057 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 56 - DNA, 37058 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 57 - DNA, 37057 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 58 - DNA, 37058 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 59 - DNA, 37057 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 60 - DNA, 37058 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 61 - DNA, 1722 bp, Artificial Sequence; identical to SEQ ID NO: 25
  Synthetic

SEQ ID NO: 62 - protein, 574 aa, Artificial Sequence; identical to SEQ ID NO: 26
  Synthetic

SEQ ID NO: 63 - DNA, 83 bp, Gorilla beringei graueri
ggcgcggcctctcgcgcgtctgctcgggatgagaaactgaccgctctgctgcttaaactggaagacttgacccgggagctggc

SEQ ID NO: 64 - DNA, 100 bp, Gorilla beringei graueri
gcttcgtcagggactcggtgggcttgcaagaagcaagcttcaacgtcttccagcggcccaccatctcctccaactcccatgccatcttcaggcagatcgc

SEQ ID NO: 65 - DNA, 45 bp, Gorilla beringei graueri
gaggagggcgcacaggagggcgcgcagaaggacatgaacgatggg

SEQ ID NO: 66 - DNA, 111 bp, Gorilla beringei graueri
tccctggcccccaagggcgctcccaattcttgcgagtgggaacaagaggaaaatcaggtggtcgctgcagatgatgaacttgaagatgaagaagcgcaagctcaagaggac

SEQ ID NO: 67 - DNA, 38 bp, Gorilla beringei graueri
tcgagggtatcaatgctttggcagtagccacaggtaag

SEQ ID NO: 68 - DNA, 399 bp, Gorilla beringei graueri; identical to SEQ ID NO: 34

SEQ ID NO: 69 - DNA, 3168 bp, Gorilla beringei graueri
atggacagctccaatgtgcgcgatgtcgtcatcaaactccgcccgccgagcgccgagatctggacctgcggctctcgcggcgtggtggtctgctccaccatcgccctccaggagacagatgctggcggccagacaaccaaagtagaagaccaccagccacacgggaccccaggcgggggacttagattcccgctgcgcttcctcgtcagaggtcgccaggttcacctcgtgcaagatatacaacccgtgcagcgctgccagtactgcggtcgcttttacaaaagccagcacgagtgctcggcccgcagacgggacttctactttcaccacatcaacagccaatcctccaactggtggcgggagatccagttcttcccgatcggctctcatcctcgcacggagcgcctctttgtcacctacgatgtagagacctacacttggatgggagcctttggcaagcagctcgtgcccttcatgctggtcatgaaactggggggcaacgaggctctggtcgccgccgcgcgcgacctcgcccgagagctcagatgggacccctgggagaaagaccccctcaccttctactgcatcacccccgaaaagatggccgtggggcgacagttcagaaccttccgcgaccgcctgcagaccctcatggcccgcgacctctggcgatccttcctggcggccaaccctcacttgcaagactgggccctggaggagcacggcctggaatcgcccgaggagctcacctacgaggaactcaaaaagctcccctccatcaagggccagccccgctttttggagctctacatcgtgggccacaacataaacggctttgacgagatcgtcctggccgcccaggtcatcaacaaccgctcctcggtcccagggccctttcgcatcaccagaaacttcatgcctcgagcggggaagatcctcttcaatgacctcaccttctccctgcccaacccgcgctccaaaaagcgcacggactacaccctgtgggaacagggcggctgcgatgacacagacttcaaacatcaatacctcaaagtcatggtcagggacactttcgccctcacccacacctccctccgcaaggcggcgcaggcctacgcgctgcccgtggagaagggctgttgcccctaccaggccgtcaaccagttctacatgctaggctcttaccgttcggacacggacgggtttcccctccaagagtactggaaagaccgcgaagagttcgtcctcaaccgcgagctgtggaaaaagaagggggaggataagtatgacatcatccgcgagaccctcgactactgcgcgctcgacgtccaggtcaccgccgagctggtgcacaagctgcgcgagtcctacgcctgcttcgtcagggactcggtgggcttgcaagaagcaagcttcaacgtcttccagcggcccaccatctcctccaactcccatgccatcttcaggcagatcgccttccgcgccgagcgcccccagcgcaccaacctcgggcccaacatgctggccccctcccacgagctctatgactacgtgcgcgccagcatccgcggggggcgctgctaccccacctacctcggcatcctcagggaacccctgtacgtgtatgacatctgcggcatgtacgcctccgcgctcacccaccccatgccctggggcccgcccctcaacccctacgagcgcgcgctcgccgcccgcgaatggcagcgggctctggacatgcaagcttgcaagatcgactactttgacccgcgcttgctccccggggtcttcaccatcgacgcggaccccccaaacgaggaccagctggaccccctaccccccttctgctcgcgcaagggcggccgcctctgctggaccaacgagcgcctgcgcggcgaggtcgccaccagcgtcgacatggtcaccctgcacaaccgaggctggagggtgcgcctgatcccagacgagcgcaccaccgtcttccccgagtggaagtgcgtggcccgcgagtacgtgcaactcaacatcgcggccaaggagcgagccgaccgcgacaaaaaccagaccctgcgctccatcgccaagctgctctccaacgccctctacgggtcgttcgccaccaagcttgacaacaaaaaaatagtgttttctgaccagatggacccaggtaccctcaaaggtatcacctccggacaggtgaacatcaaatcctcctcatttttagaaactgacaacctgagcgctgaggtcatgcccgccttcgagagggaatacttaccccagcagctggctctcgcagacagcgatgcggaagagagtgaagatgaaagggtgcccacccccttttatacccccccgtcgggaacccccggtcacgtgtcctacacctacaagccaatcacttttctggacgcggaggagggggacatgtgcctgcacaccctggagaaggtggacccgctagtggacaacgaccgctacccctcccacgtggcctccttcgtcctggcctggacgcgggccttcgtctcagagtggtcagagtttctctacgaggaggacagaggcactccgctggaagacaggcccctgaagtcggtctacggagacacggacagcctcttcgtcaccgagaagggacaccgcctcatggagagccgaggtaagaaacgcatcaaaaagcatgggggcaacctggtttttgaccctgaccgcccggagctcacttggctggtggaatgcgagacggtctgcgcttcctgcggcgcggacgcctactccccagagtccgtgtttctcgctcccaagctctacgccctgaagagcctgcagtgcccctcgtgcggcgccacctccaagggaaagctccgcgccaaggggcacgccgccgagggtctcgactacgagaccatggtcaaatgctacctggccgacgcgcagggcgaagagcggcagcgattcagcaccagcagaaccagcctcaagcgcaccctggccagcgcccaacccggagcgcaccccttcaccgtgacccagaccaccctgacgaggaccctgcgcccatggaaggacatgactctggccccgctggacgcccatcggctggtgccctacagcgaaagccgccccaacccgcgaaacgaggagatctgctggatcgagatgccg

SEQ ID NO: 70 - DNA, 1974 bp, Gorilla beringei graueri
atgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcactcagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttt

SEQ ID NO: 71 - DNA, 2865 bp, Gorilla beringei graueri
atggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagaggaaaatcaggtggtcgctgcagatgatgaacttgaagatgaagaagcgcaagctcaagaggacgccccagctaaaaaaattcatgtatatgcccaggcgcctcttgctggcgaaaagattaccaaggatggtttgcaaataggtactgaagttgtaggagatacatctaaggacacttttgcagacaaaacattccaacccgaacctcagataggcgagtctcagtggaacgaggctgatgccacagtagcaggaggcagagtcttgaaaaaaaccacccctatgagaccttgctatggatcctatgccaggcctacaaatgccaacgggggtcaaggaattatggttgccaatgaacaaggagtgttggagtctaaagtggagatgcaatttttttctaacactacaacccttaatgcgcgggatggagctggcaatcccgaaccaaaggtggtgttgtacagtgaagatgtccacttggaatctcctgacactcatttgtcttacaagcccaaaaaggatgatgttaatgctaaaattatgttgggtcagcaagctatggctaacaggcccaacctcattgcttttagagataatttcattggactcatgtactacaacagcactggtaacatgggagtgctggcgggtcaggcctctcagttgaatgccgtggtggacctgcaggatagaaacacagaactgtcatatcagcttatgcttgattccattggggatagatccagatacttctccatgtggaaccaggcagtggatagctatgacccagatgtcagaatcattgaaaaccatggtgtcgaggacgagctacccaactactgcttccctctgggcggcataggaattactgatacttatcaagggatcaaaaataccaatggcaatggtcagtggaccaaagatgatcagttcgcggaccgtaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaagaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacc

SEQ ID NO: 72 - DNA, 1740 bp, Gorilla beringei graueri
atgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagacatgcaagcgcccattagctctcgagatggaaaactggctctaacagtggcggcccccctaactgtggtcgagggtatcaatgctttggcagtagccacaggtaagggtattgggctaaatgaaaccaacacacacctgcaggcaaaactggtcgcacccctaggctttgataccaacggcaacattaagctaagcgttgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatataacatcttctaacaaccaaaacggtctagaagccaacattaaactaacaagaggccttgtgtatgacggaaatgccatagcagttaatgttggcaaagggctggaatacagccctactgacacaacagaaaaacctatacagactaaaataggtctaggcatggagtatgataccgagggagccatgatgacaaaactaggctctggactaagctttgacaattcaggagccattgtagtgggaaacaaaaatgatgacaggcttactttgtggaccacaccggacccatcgcccaactgtcagatctactctgaaaaagatgctaaactaaccttggtactgactaaatgtggcagtcaggttgtaggcacagtatctattgccgctcttaaaggtagcctcgtgccaatcactagtgcaatcagtgtggttcaggtatacctaaggtttgatgaaaatggggtactaatgagtaactcttcacttaatggcgaatactggaattttagaaacggagactcaactaatggcacaccatatacaaacgcagtgggtttcatgcctaatctactggcctatcctaaaggtcaaactacaactgcaaaaagtaacattgtcagccaggtctacatgaatggggacgatactaaacccatgacatttacaatcaacttcaatggccttagtgaaacaggggatacccctgttagtaaatattccatgacattctcatggaggtggccaaatggaagctacatagggcacaattttgtaacaaactcctttaccttctcctacatcgcccaagaa

SEQ ID NO: 73 - protein, 28 aa, Gorilla beringei graueri
GAASRASARDEKLTALLLKLEDLTRELA

SEQ ID NO: 74 - protein, 34 aa, Gorilla beringei graueri
CFVRDSVGLQEASFNVFQRPTISSNSHAIFRQIA

SEQ ID NO: 75 - protein, 15 aa, Gorilla beringei graueri
EEGAQEGAQKDMNDG

SEQ ID NO: 76 - protein, 37 aa, Gorilla beringei graueri
SLAPKGAPNSCEWEQEENQVVAADDELEDEEAQAQED

SEQ ID NO: 77 - protein, 15 aa, Gorilla beringei graueri
VEGINALAVATGKGI

SEQ ID NO: 78 - protein, 133 aa, Gorilla beringei graueri; identical to SEQ ID NO: 44

SEQ ID NO: 79 - protein, 1056 aa, Gorilla beringei graueri
MDSSNVRDVVIKLRPPSAEIWTCGSRGVVVCSTIALQETDAGGQTTKVEDHQPHGTPGGGLRFPLRFLVRGRQVHLVQDIQPVQRCQYCGRFYKSQHECSARRRDFYFHHINSQSSNWWREIQFFPIGSHPRTERLFVTYDVETYTWMGAFGKQLVPFMLVMKLGGNEALVAAARDLARELRWDPWEKDPLTFYCITPEKMAVGRQFRTFRDRLQTLMARDLWRSFLAANPHLQDWALEEHGLESPEELTYEELKKLPSIKGQPRFLELYIVGHNINGFDEIVLAAQVINNRSSVPGPFRITRNFMPRAGKILFNDLTFSLPNPRSKKRTDYTLWEQGGCDDTDFKHQYLKVMVRDTFALTHTSLRKAAQAYALPVEKGCCPYQAVNQFYMLGSYRSDTDGFPLQEYWKDREEFVLNRELWKKKGEDKYDIIRETLDYCALDVQVTAELVHKLRESYACFVRDSVGLQEASFNVFQRPTISSNSHAIFRQIAFRAERPQRTNLGPNMLAPSHELYDYVRASIRGGRCYPTYLGILREPLYVYDICGMYASALTHPMPWGPPLNPYERALAAREWQRALDMQACKIDYFDPRLLPGVFTIDADPPNEDQLDPLPPFCSRKGGRLCWTNERLRGEVATSVDMVTLHNRGWRVRLIPDERTTVFPEWKCVAREYVQLNIAAKERADRDKNQTLRSIAKLLSNALYGSFATKLDNKKIVFSDQMDPGTLKGITSGQVNIKSSSFLETDNLSAEVMPAFEREYLPQQLALADSDAEESEDERVPTPFYTPPSGTPGHVSYTYKPITFLDAEEGDMCLHTLEKVDPLVDNDRYPSHVASFVLAWTRAFVSEWSEFLYEEDRGTPLEDRPLKSVYGDTDSLFVTEKGHRLMESRGKKRIKKHGGNLVFDPDRPELTWLVECETVCASCGADAYSPESVFLAPKLYALKSLQCPSCGATSKGKLRAKGHAAEGLDYETMVKCYLADAQGEERQRFSTSRTSLKRTLASAQPGAHPFTVTQTTLTRTLRPWKDMTLAPLDAHRLVPYSESRPNPRNEEICWIEMP

SEQ ID NO: 80 - protein, 658 aa, Gorilla beringei graueri; identical to SEQ ID NO: 18

SEQ ID NO: 81 - protein, 955 aa, Gorilla beringei graueri
MATPSMMPQWSYMHISGQDASEYLSPGLVQFARATDTYFNMSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWEQEENQVVAADDELEDEEAQAQEDAPAKKIHVYAQAPLAGEKITKDGLQIGTEVVGDTSKDTFADKTFQPEPQIGESQWNEADATVAGGRVLKKTTPMRPCYGSYARPTNANGGQGIMVANEQGVLESKVEMQFFSNTTTLNARDGAGNPEPKVVLYSEDVHLESPDTHLSYKPKKDDVNAKIMLGQQAMANRPNLIAFRDNFIGLMYYNSTGNMGVLAGQASQLNAVVDLQDRNTELSYQLMLDSIGDRSRYFSMWNQAVDSYDPDVRIIENHGVEDELPNYCFPLGGIGITDTYQGIKNTNGNGQWTKDDQFADRNEIGVGNNFAMEINIQANLWRNFLYANVGLYLPDKLKYNPTNVDISDNPNTYDYMNKRVVAPGLVDCFVNVGARWSLDYMDNVNPFNHHRNAGLRYRSMILGNGRYVPFHIQVPQKFFAIKNLLLLPGSYTYEWNFRKDVNMVLQSSLGNDLRVDGASIKFDSVTLYATFFPMAHNTASTLEAMLRNDTNDQSFNDYLSGANMLYPIPAKATNVPISIPSRNWAAFRGWAFTRLKTKETPSLGSGFDPYFVYSGSIPYLDGTFYLNHTFKKISIMYDSSVSWPGNDRLLTPNEFEVKRAVDGEGYNVAQCNMTKDWFLVQMLANYNIGYQGFYIPESYKDRMYSFFRNFQPMSRQVVDETKYKDYQAIGITHQHNNSGFVGYLAPTMREGQAYPANFPYPLIGKTAVDSVTQKKFLCDRTLWRIPFSSNFMSMGALTDLGQNLLYANSAHALDMTFEVDPMDEPTLLYIVFEVFDVVRVHQPHRGVIETVYLRTPFSAGNATT

SEQ ID NO: 82 - protein, 580 aa, Gorilla beringei graueri
MKRARSSDETFNPVYPYDTEIAPTSVPFLTPPFVSSAGMQENPAGVLSLHLSEPLTTHNGALTLKMGGGLTLDKEGNLTSQNITSVDPPLKKSKNNISLQTAAPLAVSSGALTLFATPPLAVSGDNLTVQSQAPLTLEDSKLTLATKGPLTVSEGKLVLETEAPLHASDSSSLGLSVTAPLSINNDSLGLDMQAPISSRDGKLALTVAAPLTVVEGINALAVATGKGIGLNETNTHLQAKLVAPLGFDTNGNIKLSVAGGMRLNNNTLILDVNYPFEAQGQLSLRVGSGPLYVDSSSHNLTIRCLRGLYITSSNNQNGLEANIKLTRGLVYDGNAIAVNVGKGLEYSPTDTTEKPIQTKIGLGMEYDTEGAMMTKLGSGLSFDNSGAIVVGNKNDDRLTLWTTPDPSPNCQIYSEKDAKLTLVLTKCGSQVVGTVSIAALKGSLVPITSAISVVQVYLRFDENGVLMSNSSLNGEYWNFRNGDSTNGTPYTNAVGFMPNLLAYPKGQTTTAKSNIVSQVYMNGDDTKPMTFTINFNGLSETGDTPVSKYSMTFSWRWPNGSYIGHNFVTNSFTFSYIAQE

SEQ ID NO: 83 - DNA, 37211 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgtagggcaagaaaattaccttctattctgtgcaagtctaagacacctgtgaggaccagcgaggcggacagcaccgactctggcacttctacctctcctcctgaaattcacccagtggttcctctgggtatacatagacctgttgctgttagagtttgcgggcgacgctctgcagtagagtgcattgaggacttgcttcacgaacccgaggaacctttggacttgagcgttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggcttacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtacacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacaaatcgggggcggagggtcccggactgggggatgatggtgccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagtctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtctccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcaccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaagcaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgttgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgcgagaaggcgttgagcccgccctcgttccagacccggctgtagaccacgcccccctcggcgttgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggttttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgagaagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcactcagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgccgtggccccgcgggcacgaaggcgcgcggccgccgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagaggaaaatcaggtggtcgctgcagatgatgaacttgaagatgaagaagcgcaagctcaagaggacgccccagctaaaaaaattcatgtatatgcccaggcgcctcttgctggcgaaaagattaccaaggatggtttgcaaataggtactgaagttgtaggagatacatctaaggacacttttgcagacaaaacattccaacccgaacctcagataggcgagtctcagtggaacgaggctgatgccacagtagcaggaggcagagtcttgaaaaaaaccacccctatgagaccttgctatggatcctatgccaggcctacaaatgccaacgggggtcaaggaattatggttgccaatgaacaaggagtgttggagtctaaagtggagatgcaatttttttctaacactacaacccttaatgcgcgggatggagctggcaatcccgaaccaaaggtggtgttgtacagtgaagatgtccacttggaatctcctgacactcatttgtcttacaagcccaaaaaggatgatgttaatgctaaaattatgttgggtcagcaagctatggctaacaggcccaacctcattgcttttagagataatttcattggactcatgtactacaacagcactggtaacatgggagtgctggcgggtcaggcctctcagttgaatgccgtggtggacctgcaggatagaaacacagaactgtcatatcagcttatgcttgattccattggggatagatccagatacttctccatgtggaaccaggcagtggatagctatgacccagatgtcagaatcattgaaaaccatggtgtcgaggacgagctacccaactactgcttccctctgggcggcataggaattactgatacttatcaagggatcaaaaataccaatggcaatggtcagtggaccaaagatgatcagttcgcggaccgtaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaagaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaacaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggctcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattacgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgtggcccgtctgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagctccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagacgcttctttgggggcgcgcgcgtcagcggcggcggagacggggacggggacggggacgggacgccctccacagggggtggtcttcgcgcagacccgcggccgcgctcgggggtcttttcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggaccccccagccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctcaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagattttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgagaaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggcctcctcgccagggtataactcacctggagatccgaggcagaggtattcagctcaacgacgagtcggtgagctcctcgctcggtctaagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaacgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaaacgctttcacgcttgattgctaacaccgggtttttatccgcagaatgattggaatcaccctactaatcacctccctccttgcgattgcccatgggttggaacgaatcgaagcccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatctaaccttgattgatgttcaaatgctggatgcgggctactattatgggcagctgggtacaatgattaattactggagaccccacaaagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgcctttgctgaggatttggaagaccacgaggaagatgagcatgacttcgcagatgcatgccaggcatcagaggcagaagcgctgccggtggccctcaaacagtatgcagacccccacaccacccccaaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccagaagttcgccctcatgataggcgaacaacccatcaccgtgacccagcactccgtggagacagaaggctgcatacacgctccctgtaggggcgctgactgcctctacaccttgatcaaaaccctctgcggtctcagagacctcatcccttttaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagacatgcaagcgcccattagctctcgagatggaaaactggctctaacagtggcggcccccctaactgtggtcgagggtatcaatgctttggcagtagccacaggtaagggtattgggctaaatgaaaccaacacacacctgcaggcaaaactggtcgcacccctaggctttgataccaacggcaacattaagctaagcgttgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatataacatcttctaacaaccaaaacggtctagaagccaacattaaactaacaagaggccttgtgtatgacggaaatgccatagcagttaatgttggcaaagggctggaatacagccctactgacacaacagaaaaacctatacagactaaaataggtctaggcatggagtatgataccgagggagccatgatgacaaaactaggctctggactaagctttgacaattcaggagccattgtagtgggaaacaaaaatgatgacaggcttactttgtggaccacaccggacccatcgcccaactgtcagatctactctgaaaaagatgctaaactaaccttggtactgactaaatgtggcagtcaggttgtaggcacagtatctattgccgctcttaaaggtagcctcgtgccaatcactagtgcaatcagtgtggttcaggtatacctaaggtttgatgaaaatggggtactaatgagtaactcttcacttaatggcgaatactggaattttagaaacggagactcaactaatggcacaccatatacaaacgcagtgggtttcatgcctaatctactggcctatcctaaaggtcaaactacaactgcaaaaagtaacattgtcagccaggtctacatgaatggggacgatactaaacccatgacatttacaatcaacttcaatggccttagtgaaacaggggatacccctgttagtaaatattccatgacattctcatggaggtggccaaatggaagctacatagggcacaattttgtaacaaactcctttaccttctcctacatcgcccaagaataaagaaagcacagagatgcttgtttttgatttcaaaattgtgtgcttttatttattttcagcttacagtatttccagtagtcattcaaataaagcttaatcaaactgcatgagaacccttccacatagcttaaattagcaccagtgcaaatggagaaaaatcaacatacctttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgtgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctaaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacaaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacggtacgtcacttccgcaagaaaagcaaaactacatttcccacatgtgtaaaaacgaaaccccgccccttgtaaccgcccacaacttacatcatcaaaacgtaaactcctacgtcacccgccccgcctctccccgcccacctcattatcatattggccacaatccaaaataaggtatattattgatgatg

SEQ ID NO: 84 - DNA, 37213 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgtagggcaagaaaattaccttctattctgtgcaagtctaagacacctgtgaggaccagcgaggcggacagcaccgactctggcacttctacctctcctcctgaaattcacccagtggttcctctgggtatacatagacctgttgctgttagagtttgcgggcgacgctctgcagtagagtgcattgaggacttgcttcacgaacccgaggaacctttggacttgagcgttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggcttacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtacacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacaaatcgggggcggagggtcccggactgggggatgatggtgccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagtctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtctccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcaccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaagcaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgttgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgcgagaaggcgttgagcccgccctcgttccagacccggctgtagaccacgcccccctcggcgttgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggttttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgagaagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcactcagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgccgtggccccgcgggcacgaaggcgcgcggccgccgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaaataaaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagaggaaaatcaggtggtcgctgcagatgatgaacttgaagatgaagaagcgcaagctcaagaggacgccccagctaaaaaaattcatgtatatgcccaggcgcctcttgctggcgaaaagattaccaaggatggtttgcaaataggtactgaagttgtaggagatacatctaaggacacttttgcagacaaaacattccaacccgaacctcagataggcgagtctcagtggaacgaggctgatgccacagtagcaggaggcagagtcttgaaaaaaaccacccctatgagaccttgctatggatcctatgccaggcctacaaatgccaacgggggtcaaggaattatggttgccaatgaacaaggagtgttggagtctaaagtggagatgcaatttttttctaacactacaacccttaatgcgcgggatggagctggcaatcccgaaccaaaggtggtgttgtacagtgaagatgtccacttggaatctcctgacactcatttgtcttacaagcccaaaaaggatgatgttaatgctaaaattatgttgggtcagcaagctatggctaacaggcccaacctcattgcttttagagataatttcattggactcatgtactacaacagcactggtaacatgggagtgctggcgggtcaggcctctcagttgaatgccgtggtggacctgcaggatagaaacacagaactgtcatatcagcttatgcttgattccattggggatagatccagatacttctccatgtggaaccaggcagtggatagctatgacccagatgtcagaatcattgaaaaccatggtgtcgaggacgagctacccaactactgcttccctctgggcggcataggaattactgatacttatcaagggatcaaaaataccaatggcaatggtcagtggaccaaagatgatcagttcgcggaccgtaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaagaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaacaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggctcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattacgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgtggcccgtctgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagctccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagacgcttctttgggggcgcgcgcgtcagcggcggcggagacggggacggggacggggacgggacgccctccacagggggtggtcttcgcgcagacccgcggccgcgctcgggggtcttttcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggaccccccagccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctcaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagattttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgagaaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggcctcctcgccagggtataactcacctggagatccgaggcagaggtattcagctcaacgacgagtcggtgagctcctcgctcggtctaagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaacgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaaacgctttcacgcttgattgctaacaccgggtttttatccgcagaatgattggaatcaccctactaatcacctccctccttgcgattgcccatgggttggaacgaatcgaagcccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatctaaccttgattgatgttcaaatgctggatgcgggctactattatgggcagctgggtacaatgattaattactggagaccccacaaagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgcctttgctgaggatttggaagaccacgaggaagatgagcatgacttcgcagatgcatgccaggcatcagaggcagaagcgctgccggtggccctcaaacagtatgcagacccccacaccacccccaaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccagaagttcgccctcatgataggcgaacaacccatcaccgtgacccagcactccgtggagacagaaggctgcatacacgctccctgtaggggcgctgactgcctctacaccttgatcaaaaccctctgcggtctcagagacctcatcccttttaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagacatgcaagcgcccattagctctcgagatggaaaactggctctaacagtggcggcccccctaactgtggtcgagggtatcaatgctttggcagtagccacaggtaagggtattgggctaaatgaaaccaacacacacctgcaggcaaaactggtcgcacccctaggctttgataccaacggcaacattaagctaagcgttgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatataacatcttctaacaaccaaaacggtctagaagccaacattaaactaacaagaggccttgtgtatgacggaaatgccatagcagttaatgttggcaaagggctggaatacagccctactgacacaacagaaaaacctatacagactaaaataggtctaggcatggagtatgataccgagggagccatgatgacaaaactaggctctggactaagctttgacaattcaggagccattgtagtgggaaacaaaaatgatgacaggcttactttgtggaccacaccggacccatcgcccaactgtcagatctactctgaaaaagatgctaaactaaccttggtactgactaaatgtggcagtcaggttgtaggcacagtatctattgccgctcttaaaggtagcctcgtgccaatcactagtgcaatcagtgtggttcaggtatacctaaggtttgatgaaaatggggtactaatgagtaactcttcacttaatggcgaatactggaattttagaaacggagactcaactaatggcacaccatatacaaacgcagtgggtttcatgcctaatctactggcctatcctaaaggtcaaactacaactgcaaaaagtaacattgtcagccaggtctacatgaatggggacgatactaaacccatgacatttacaatcaacttcaatggccttagtgaaacaggggatacccctgttagtaaatattccatgacattctcatggaggtggccaaatggaagctacatagggcacaattttgtaacaaactcctttaccttctcctacatcgcccaagaataaagaaagcacagagatgcttgtttttgatttcaaaattgtgtgcttttatttattttcagcttacagtatttccagtagtcattcaaataaagcttaatcaaactgcatgagaacccttccacatagcttaaattagcaccagtgcaaatggagaaaaatcaacatacctttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgtgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctaaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacaaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacggtacgtcacttccgcaagaaaagcaaaactacatttcccacatgtgtaaaaacgaaaccccgccccttgtaaccgcccacaacttacatcatcaaaacgtaaactcctacgtcacccgccccgcctctccccgcccacctcattatcatattggccacaatccaaaataaggtatattattgatgatg

SEQ ID NO: 85 - DNA, 37195 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgtagggcaagaaaattaccttctattctgtgcaagtctaagacacctgtgaggaccagcgaggcggacagcaccgactctggcacttctacctctcctcctgaaattcacccagtggttcctctgggtatacatagacctgttgctgttagagtttgcgggcgacgctctgcagtagagtgcattgaggacttgcttcacgaacccgaggaacctttggacttgagcgttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggcttacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtacacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacaaatcgggggcggagggtcccggactgggggatgatggtgccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagtctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtctccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcaccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaagcaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgttgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgcgagaaggcgttgagcccgccctcgttccagacccggctgtagaccacgcccccctcggcgttgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggttttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgagaagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcactcagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgccgtggccccgcgggcacgaaggcgcgcggccgccgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagaggaaaatcaggtggtcgctgcagatgatgaacttgaagatgaagaagcgcaagctcaagaggacgccccagctaaaaaaattcatgtatatgcccaggcgcctcttgctggcgaaaagattaccaaggatggtttgcaaataggtactgaagttgtaggagatacatctaaggacacttttgcagacaaaacattccaacccgaacctcagataggcgagtctcagtggaacgaggctgatgccacagtagcaggaggcagagtcttgaaaaaaaccacccctatgagaccttgctatggatcctatgccaggcctacaaatgccaacgggggtcaaggaattatggttgccaatgaacaaggagtgttggagtctaaagtggagatgcaatttttttctaacactacaacccttaatgcgcgggatggagctggcaatcccgaaccaaaggtggtgttgtacagtgaagatgtccacttggaatctcctgacactcatttgtcttacaagcccaaaaaggatgatgttaatgctaaaattatgttgggtcagcaagctatggctaacaggcccaacctcattgcttttagagataatttcattggactcatgtactacaacagcactggtaacatgggagtgctggcgggtcaggcctctcagttgaatgccgtggtggacctgcaggatagaaacacagaactgtcatatcagcttatgcttgattccattggggatagatccagatacttctccatgtggaaccaggcagtggatagctatgacccagatgtcagaatcattgaaaaccatggtgtcgaggacgagctacccaactactgcttccctctgggcggcataggaattactgatacttatcaagggatcaaaaataccaatggcaatggtcagtggaccaaagatgatcagttcgcggaccgtaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaagaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaacaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggctcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattacgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgtggcccgtctgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagctccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagacgcttctttgggggcgcgcgcgtcagcggcggcggagacggggacggggacggggacgggacgccctccacagggggtggtcttcgcgcagacccgcggccgcgctcgggggtcttttcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggaccccccagccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctcaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagattttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgagaaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggcctcctcgccagggtataactcacctggagatccgaggcagaggtattcagctcaacgacgagtcggtgagctcctcgctcggtctaagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaacgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaaacgctttcacgcttgattgctaacaccgggtttttatccgcagaatgattggaatcaccctactaatcacctccctccttgcgattgcccatgggttggaacgaatcgaagcccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatctaaccttgattgatgttcaaatgctggatgcgggctactattatgggcagctgggtacaatgattaattactggagaccccacaaagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgcctttgctgaggatttggaagaccacgaggaagatgagcatgacttcgcagatgcatgccaggcatcagaggcagaagcgctgccggtggccctcaaacagtatgcagacccccacaccacccccaaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccagaagttcgccctcatgataggcgaacaacccatcaccgtgacccagcactccgtggagacagaaggctgcatacacgctccctgtaggggcgctgactgcctctacaccttgatcaaaaccctctgcggtctcagagacctcatcccttttaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagacatgcaagcgcccattagctctcgagatggaaaactggctctaacagtggcggcccccctaactgtggtcgagggtatcaatgctttggcagtagccacaggtaagggtattgggctaaatgaaaccaacacacacctgcaggcaaaactggtcgcacccctaggctttgataccaacggcaacattaagctaagcgttgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatataacatcttctaacaaccaaaacggtctagaagccaacattaaactaacaagaggccttgtgtatgacggaaatgccatagcagttaatgttggcaaagggctggaatacagccctactgacacaacagaaaaacctatacagactaaaataggtctaggcatggagtatgataccgagggagccatgatgacaaaactaggctctggactaagctttgacaattcaggagccattgtagtgggaaacaaaaatgatgacaggcttactttgtggaccacaccggacccatcgcccaactgtcagatctactctgaaaaagatgctaaactaaccttggtactgactaaatgtggcagtcaggttgtaggcacagtatctattgccgctcttaaaggtagcctcgtgccaatcactagtgcaatcagtgtggttcaggtatacctaaggtttgatgaaaatggggtactaatgagtaactcttcacttaatggcgaatactggaattttagaaacggagactcaactaatggcacaccatatacaaacgcagtgggtttcatgcctaatctactggcctatcctaaaggtcaaactacaactgcaaaaagtaacattgtcagccaggtctacatgaatggggacgatactaaacccatgacatttacaatcaacttcaatggccttagtgaaacaggggatacccctgttagtaaatattccatgacattctcatggaggtggccaaatggaagctacatagggcacaattttgtaacaaactcctttaccttctcctacatcgcccaagaataaagaaagcacagagatgcttgtttttgatttcaaaattgtgtgcttttatttattttcagcttacagtatttccagtagtcattcaaataaagcttaatcaaactgcatgagaacccttccacatagcttaaattagcaccagtgcaaatggagaaaaatcaacatacctttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgtgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctaaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacaaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacggtacgtcacttccgcaagaaaagcaaaactacatttcccacatgtgtaaaaacgaaaccccgccccttgtaaccgcccacaacttacatcatcaaaacgtaaactcctacgtcacccgccccgcctctccccgcccacctcattatcatattggccacaatccaaaataaggtatattat

SEQ ID NO: 86 - DNA, 37197 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgtagggcaagaaaattaccttctattctgtgcaagtctaagacacctgtgaggaccagcgaggcggacagcaccgactctggcacttctacctctcctcctgaaattcacccagtggttcctctgggtatacatagacctgttgctgttagagtttgcgggcgacgctctgcagtagagtgcattgaggacttgcttcacgaacccgaggaacctttggacttgagcgttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtctcttggggctaaacttggttacacttgaccccaatggaggcgtgggggtgcttggaggagtttgcggacgtgcgccgtttgctggacgagagctctagcaatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggcttacaacaaatggaagattcagaaggaactgtacggttccgccctacgtcgtccacttctgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtattcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggcaactgtcacctgttgaagaccattcatataagcagccaccccagaaaggcctggcccgtgtttgagcataacatcttgacccgctgctccttgcatctgggggtcaggaggggtatgttcctgccttaccagtgtaactttagccacactaaaatcctgctggaacccgagtgcatgaccaaggtcagcctgaatggtgtgtttgatgtgactctgaaaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtacacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacaaatcgggggcggagggtcccggactgggggatgatggtgccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagtctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtctccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcaccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaagcaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgttgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgcgagaaggcgttgagcccgccctcgttccagacccggctgtagaccacgcccccctcggcgttgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggttttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgagaagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcactcagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgccgtggccccgcgggcacgaaggcgcgcggccgccgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaaataaaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagaggaaaatcaggtggtcgctgcagatgatgaacttgaagatgaagaagcgcaagctcaagaggacgccccagctaaaaaaattcatgtatatgcccaggcgcctcttgctggcgaaaagattaccaaggatggtttgcaaataggtactgaagttgtaggagatacatctaaggacacttttgcagacaaaacattccaacccgaacctcagataggcgagtctcagtggaacgaggctgatgccacagtagcaggaggcagagtcttgaaaaaaaccacccctatgagaccttgctatggatcctatgccaggcctacaaatgccaacgggggtcaaggaattatggttgccaatgaacaaggagtgttggagtctaaagtggagatgcaatttttttctaacactacaacccttaatgcgcgggatggagctggcaatcccgaaccaaaggtggtgttgtacagtgaagatgtccacttggaatctcctgacactcatttgtcttacaagcccaaaaaggatgatgttaatgctaaaattatgttgggtcagcaagctatggctaacaggcccaacctcattgcttttagagataatttcattggactcatgtactacaacagcactggtaacatgggagtgctggcgggtcaggcctctcagttgaatgccgtggtggacctgcaggatagaaacacagaactgtcatatcagcttatgcttgattccattggggatagatccagatacttctccatgtggaaccaggcagtggatagctatgacccagatgtcagaatcattgaaaaccatggtgtcgaggacgagctacccaactactgcttccctctgggcggcataggaattactgatacttatcaagggatcaaaaataccaatggcaatggtcagtggaccaaagatgatcagttcgcggaccgtaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaagaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaacaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggctcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattacgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgtggcccgtctgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagctccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagacgcttctttgggggcgcgcgcgtcagcggcggcggagacggggacggggacggggacgggacgccctccacagggggtggtcttcgcgcagacccgcggccgcgctcgggggtcttttcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggaccccccagccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctcaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagattttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgagaaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggcctcctcgccagggtataactcacctggagatccgaggcagaggtattcagctcaacgacgagtcggtgagctcctcgctcggtctaagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaacgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaaacgctttcacgcttgattgctaacaccgggtttttatccgcagaatgattggaatcaccctactaatcacctccctccttgcgattgcccatgggttggaacgaatcgaagcccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatctaaccttgattgatgttcaaatgctggatgcgggctactattatgggcagctgggtacaatgattaattactggagaccccacaaagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgcctttgctgaggatttggaagaccacgaggaagatgagcatgacttcgcagatgcatgccaggcatcagaggcagaagcgctgccggtggccctcaaacagtatgcagacccccacaccacccccaaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccagaagttcgccctcatgataggcgaacaacccatcaccgtgacccagcactccgtggagacagaaggctgcatacacgctccctgtaggggcgctgactgcctctacaccttgatcaaaaccctctgcggtctcagagacctcatcccttttaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagacatgcaagcgcccattagctctcgagatggaaaactggctctaacagtggcggcccccctaactgtggtcgagggtatcaatgctttggcagtagccacaggtaagggtattgggctaaatgaaaccaacacacacctgcaggcaaaactggtcgcacccctaggctttgataccaacggcaacattaagctaagcgttgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatataacatcttctaacaaccaaaacggtctagaagccaacattaaactaacaagaggccttgtgtatgacggaaatgccatagcagttaatgttggcaaagggctggaatacagccctactgacacaacagaaaaacctatacagactaaaataggtctaggcatggagtatgataccgagggagccatgatgacaaaactaggctctggactaagctttgacaattcaggagccattgtagtgggaaacaaaaatgatgacaggcttactttgtggaccacaccggacccatcgcccaactgtcagatctactctgaaaaagatgctaaactaaccttggtactgactaaatgtggcagtcaggttgtaggcacagtatctattgccgctcttaaaggtagcctcgtgccaatcactagtgcaatcagtgtggttcaggtatacctaaggtttgatgaaaatggggtactaatgagtaactcttcacttaatggcgaatactggaattttagaaacggagactcaactaatggcacaccatatacaaacgcagtgggtttcatgcctaatctactggcctatcctaaaggtcaaactacaactgcaaaaagtaacattgtcagccaggtctacatgaatggggacgatactaaacccatgacatttacaatcaacttcaatggccttagtgaaacaggggatacccctgttagtaaatattccatgacattctcatggaggtggccaaatggaagctacatagggcacaattttgtaacaaactcctttaccttctcctacatcgcccaagaataaagaaagcacagagatgcttgtttttgatttcaaaattgtgtgcttttatttattttcagcttacagtatttccagtagtcattcaaataaagcttaatcaaactgcatgagaacccttccacatagcttaaattagcaccagtgcaaatggagaaaaatcaacatacctttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgtgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcactgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctaaaccaggaagccagcacctgaccccccgccaggcactgcagggaccccggtgaatcgcagtggcagtgaagactccagcgctcgtagccgtgaaccatagagctggtcattatatccacattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacaaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacggtacgtcacttccgcaagaaaagcaaaactacatttcccacatgtgtaaaaacgaaaccccgccccttgtaaccgcccacaacttacatcatcaaaacgtaaactcctacgtcacccgccccgcctctccccgcccacctcattatcatattggccacaatccaaaataaggtatattat

SEQ ID NO: 87 - DNA, 1722 bp, Artificial Sequence; identical to SEQ ID NO: 25
  Synthetic

SEQ ID NO: 88 - protein, 574 aa, Artificial Sequence; identical to SEQ ID NO: 26
  Synthetic

SEQ ID NO: 89 - DNA, 34029 bp, Gorilla beringei beringei
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacgcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagggccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggattaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgtgagaaggcgttgagcccgccctcgttccagacccggctgtagaccacgcccccctcggcgtcgcgagcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgttgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgagcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtaaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgtttatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgaggagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcacccagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgtcgtggccccgcgggcacgaaggcgcgcggccgctgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgtgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaaagtctagactctcacgctcgcttggtcctgtgactattttgtagaaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagatgaaccagctcaggcagcaatagctgaagatgaagaagaacttgaagaagaacaagctcaggacgaacaggcgcccactaagaaaacccatgtatacgcccaggcacctctttctggtgaaaaaattactaaggatggtttgcaaataggtgtggatgccacacaggcgggagataaccctatatatgctgataaaacattccaacccgaacctcagataggtgagtctcagtggaacgaggctgatgccacagtagcaggaggcagagtcttaaaaaagaccacccctatgagaccttgctatggatcctatgccaaacctactaatgccaatggcggtcaagggatcatggtggccaatgatcagggagcgcttgaatctaaagttgagatgcaatttttctccaccacaacgtctcttaatgtaagggaaggtgaaaacaatcttcagccaaaagtagtgctatacagcgaagatgttaacttggaatcccctgacactcatttgtcttacaaacctaaaaaggatgacaccaactctaaaatcatgttgggtcagcaagccatgcccaacagacccaacctcattgcttttagggacaactttattggacttatgtactacaacagcacaggcaacatgggagtgctggcaggacaggcctcccagctaaacgctgtggtagacttgcaagacagaaacacagagctgtcataccaactgatgcttgattccattggagacagatcaagatacttttccatgtggaaccaggcagtggacagctatgacccagatgtcagaatcattgaaaaccatggggttgaagatgagctgcccaactattgctttcccctgggcggtattggaattacagacacataccagtgcataaaaccaaccgcagctgctaataacactacatggtctaaggatgaagaatttagtgatcgcaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaaaaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttaaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaacggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtaccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggcgcgcttcttttttttcttgggagcggccgtgatggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccattgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtacccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtaccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgtggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagatctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagactttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcaaagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacgagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaatgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaatagccacaagcccagagccatctgcgatgggcaaaatctaaccttgattgatgttcaattgctggatgcgggctactattatgggcagctgggtacaatgattaattactggagaccccacagagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgaaaccaccgagatctgcttctgcaaatgctctgacgccattgcccaggatttggaagatcacgaggaagatgagcatgacttcgcagatgcatgccaggcatcagagccagaagcgctgccggtggccctcaaacagtatgcagacccccacaccacccccgaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccaaaagttcgccctcatgataggcgaacaacccatcaccgtgacccagcactccgtggagacagaaggctgcatacatgctccctgtaggggcgctgactgcctctacaccttgatcaaaaccctctgcggtctcagagaccttatccctttcaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagatctgcaggcacccattgtctctcaaaatggaaaactggctctaaatgtagcaggccccctagctgtggccaatggcattaatgctttgacagtaggcacaggcaaaggtattggtctaaatgaaaccagcactcacttgcaagcaaagttggtcgcccccctaggctttgataccaatggcaacattaagctaagcgttgcaggaggcatgagactaaataatgacacacttatactagatgtaaactacccatttgaagctcaaggccaactaagtctaagagtgggccagggtccgctgtatgtagattctagcagccataacctgaccattagatgccttagaggattatacataacatcgtctaataaccaaaccggtctagaggccaacataaaactaacaaaaggccttgtctatgatggaaatgccatagcagtcaatgttggtcaaggattgcaatacagcactactgccacatcggaaggtgtgtatcctatacagtctaagataggtttgggaatggaatatgataccaacggagccatgatgacaaaactaggctctggactaagctttgacaattcaggagccattgtagtgggaaacaaaaatgatgacaggcttactctgtggactacaccagacccatctcctaactgtagaatttattctgaaaaagatactaaactaaccttggtgctgactaagtgtggcagccaaatcctaggcacagtatctgcccttgctgtcagaggcagccttgcgcccatcactaatgcatccagcatagtccaaatatttctaagatttgatgaaaatggactattgatgagcaactcatcgctagacggtgattactggaattacagaaatggggactccactaatagcacaccatatacaaatgcagtaggctttatgcctaatctagcagcctatcctaaaggtcaggctacagctgcaaaaagcagtattgtaagccaggtatacatggatggtgacactactaaacctataacactaaaaataaacttcaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgttttgatttcaaaattgtgtgcttttatttattttcagcttacagtatttccagtagtcattcgaataaagcttaatcaaactgcatgagaacccttccacatagcttaaattagcaccagtgcaaatggagaaaagcctcgaggtcgttgcgcggccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgcacgtcgtaccggcaattgccgcggcaattgccgacgccgcgtaactataacggtcctaaggtagcgagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccggtttctcacggtacgtcacttccgcaagaaaagcaaaactacatttcccacatgtgtaaaaacgaaaccccgccccttgtaactgcccacaacttacatcatcaaaacataaactcctacgtcacccgccccgcctctccccgcccacctcattatcatattggccacaatccaaaataaggtatattattgatgatg

SEQ ID NO: 90 - DNA, 36927 bp, Gorilla beringei beringei
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacagggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatctttctagctagtctagactagctagactcgagagcggccgcaatcgataagcttgatatcgaattctgcagtgatcagggatcctcatcagttggagaaggcgatgttgttgatgccggacagctggtccttggacagggtcacgggggtggatctggccttacagtacagcagcaggcccacagcaatcagagacagcaggatcacaatgatcacgatgatgattgtggtgatcatgatgttggtggtgctcttgccggcattcacattgtgcagcagctcgtcgctcttcctgatgaaggccaggctctggttgatcttctcgttcacctggctgatgctggcatcgaactcgtcgctagggaacaccagggggtcgtagaagttgatgatgggctcgcccttcacgtacaggctcttgccctcctgcttattcacgtagtacagtgtgttgcccacagacacggtgtccacgcccttgttggacacgtagtcacagccgttgctgaaggtcttgatgatcccccggttcttgttgctggcggtacacttggtcttgccgtagcaggacacgatggcgcccaggctggtaatcacgctgctggacacgtcggtcttggaggtcatgatcttacagtcgtacttggggttgaagatgtccacgttacacaggttcacctcgctgggcagggtcaggctgttcatggtgtcacagaacacccggttgctctgcaccttacaggtctcggcctgggggaagaaggacacgctgccggcattgtcacagtaccagcctctatcggtcctggtcaggcagatgttgctgccctccttggtgttggtggtacacagagggctggtgtgcagcttccagcaaggggtatcgatcacgccgtacaggggcagctgcaccacgtaggccagcacctcttccttgatgatgctcatgatgctgtagctctgctgcctcacaatctgcacgttgttgctcatcagctttttctggtcgttggtgatgggcatgtcattgatcagggacagcagctcgctgttggtcagcatgtaggtgctcacaggggtggtcacgccggcgttcacgctgaactccctggtgatctccagcagccggttgttcttctgctggaactcgatcacggtctcgatgttgctgatggagcagctctgcttgttcacgatgggcagcagctgcttgtcgatgtagttcttcagatccagcaccttgctggtcagcacggacacgccgttgctcagggacaccacggccttgttggtggacagcagggcgctcttgatcttgttcacctcgccctccaggtgcagcaccttagacacggccactccgctggcgatggcgctgcccactcccagcaggaagcccaggaatctccgcttccgcttcttgctcagggtcacgttggttttcttggcgttgttcagggtgtagttcatgaaccggggcagctcgcgcctggctctgttgttggtggcgggggtgctctgcatcagcagctgcagctcggtcacggcgttcttgtacttgtccagctcctgcttgatcagcttcaccttggcgtcggtgccgttacacttgttttccttgatgttggacagctcgatggtgatcacgctggtgtaccagccggttctcagggcgctcaggtagcccttggacacggcgctacaggtgctctggtagaactcctcggtgatattctggccgctggcgaagcagaaggtcacggcggtcaggatggtggtgatggcgttggccttcaggatcagcagctccatggtggcgtcgacggtaccggctgcagttggacctgggagtggacacctgtggagagaaaggcaaagtggatgtcattgtcactcaagtgtatggccagatctcaagcctgccacacctcaagtgaagccaagggggtgggcctatagactctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctcgtcgacgatctctatcactgatagggagatctctatcactgatagggagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtgcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacgaatcgggggcggagggtcccggactgggggatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagggccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggattaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgtgagaaggcgttgagcccgccctcgttccagacccggctgtagaccacgcccccctcggcgtcgcgagcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgttgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgagcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtaaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgtttatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgaggagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcacccagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgtcgtggccccgcgggcacgaaggcgcgcggccgctgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgtgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaaagtctagactctcacgctcgcttggtcctgtgactattttgtagaaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagatgaaccagctcaggcagcaatagctgaagatgaagaagaacttgaagaagaacaagctcaggacgaacaggcgcccactaagaaaacccatgtatacgcccaggcacctctttctggtgaaaaaattactaaggatggtttgcaaataggtgtggatgccacacaggcgggagataaccctatatatgctgataaaacattccaacccgaacctcagataggtgagtctcagtggaacgaggctgatgccacagtagcaggaggcagagtcttaaaaaagaccacccctatgagaccttgctatggatcctatgccaaacctactaatgccaatggcggtcaagggatcatggtggccaatgatcagggagcgcttgaatctaaagttgagatgcaatttttctccaccacaacgtctcttaatgtaagggaaggtgaaaacaatcttcagccaaaagtagtgctatacagcgaagatgttaacttggaatcccctgacactcatttgtcttacaaacctaaaaaggatgacaccaactctaaaatcatgttgggtcagcaagccatgcccaacagacccaacctcattgcttttagggacaactttattggacttatgtactacaacagcacaggcaacatgggagtgctggcaggacaggcctcccagctaaacgctgtggtagacttgcaagacagaaacacagagctgtcataccaactgatgcttgattccattggagacagatcaagatacttttccatgtggaaccaggcagtggacagctatgacccagatgtcagaatcattgaaaaccatggggttgaagatgagctgcccaactattgctttcccctgggcggtattggaattacagacacataccagtgcataaaaccaaccgcagctgctaataacactacatggtctaaggatgaagaatttagtgatcgcaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaaaaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttaaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaacggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtaccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggcgcgcttcttttttttcttgggagcggccgtgatggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcttctcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccattgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtacccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtaccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgtggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagatctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagactttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcacagctcgcgggcggctgtcgtcacagggtgcggcctcctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcaaagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacgagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaatgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcattgatgaaaagaaaatgccttaatcgctttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaatagccacaagcccagagccatctgcgatgggcaaaatctaaccttgattgatgttcaattgctggatgcgggctactattatgggcagctgggtacaatgattaattactggagaccccacagagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgaaaccaccgagatctgcttctgcaaatgctctgacgccattgcccaggatttggaagatcacgaggaagatgagcatgacttcgcagatgcatgccaggcatcagagccagaagcgctgccggtggccctcaaacagtatgcagacccccacaccacccccgaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccaaaagttcgccctcatgataggcgaacaacccatcaccgtgacccagcactccgtggagacagaaggctgcatacatgctccctgtaggggcgctgactgcctctacaccttgatcaaaaccctctgcggtctcagagaccttatccctttcaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagatctgcaggcacccattgtctctcaaaatggaaaactggctctaaatgtagcaggccccctagctgtggccaatggcattaatgctttgacagtaggcacaggcaaaggtattggtctaaatgaaaccagcactcacttgcaagcaaagttggtcgcccccctaggctttgataccaatggcaacattaagctaagcgttgcaggaggcatgagactaaataatgacacacttatactagatgtaaactacccatttgaagctcaaggccaactaagtctaagagtgggccagggtccgctgtatgtagattctagcagccataacctgaccattagatgccttagaggattatacataacatcgtctaataaccaaaccggtctagaggccaacataaaactaacaaaaggccttgtctatgatggaaatgccatagcagtcaatgttggtcaaggattgcaatacagcactactgccacatcggaaggtgtgtatcctatacagtctaagataggtttgggaatggaatatgataccaacggagccatgatgacaaaactaggctctggactaagctttgacaattcaggagccattgtagtgggaaacaaaaatgatgacaggcttactctgtggactacaccagacccatctcctaactgtagaatttattctgaaaaagatactaaactaaccttggtgctgactaagtgtggcagccaaatcctaggcacagtatctgcccttgctgtcagaggcagccttgcgcccatcactaatgcatccagcatagtccaaatatttctaagatttgatgaaaatggactattgatgagcaactcatcgctagacggtgattactggaattacagaaatggggactccactaatagcacaccatatacaaatgcagtaggctttatgcctaatctagcagcctatcctaaaggtcaggctacagctgcaaaaagcagtattgtaagccaggtatacatggatggtgacactactaaacctataacactaaaaataaacttcaatggcattgatgaaacaacagaaaatacccctgttagtaaatattccatgacattctcatggagctggcccaccgcaagctacataggccacacttttgcaacaaactcttttactttctcctacatcgcccaagaataaagaaagcacagagatgcttgttttgatttcaaaattgtgtgcttttatttattttcagcttacagtatttccagtagtcattcgaataaagcttaatcaaactgcatgagaacccttccacatagcttaaattagcaccagtgcaaatggagaaaagcctcgaggtcgttgcgcggccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgcacgtcgtaccggcaattgccgcggcaattgccgacgccgcgtaactataacggtcctaaggtagcgagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccggtttctcacggtacgtcacttccgcaagaaaagcaaaactacatttcccacatgtgtaaaaacgaaaccccgccccttgtaactgcccacaacttacatcatcaaaacataaactcctacgtcacccgccccgcctctccccgcccacctcattatcatattggccacaatccaaaataaggtatattattgatgatg

SEQ ID NO: 91 - DNA, 33861 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacgcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaagctctagagcgcggccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgcacgtcggagtataccggggtaccccgacgccgcgtaactataacggtcctaaggtagcgaaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 92 - DNA, 33861 bp, Gorilla beringei graueri
  misc_feature (489)..(489): C,T
  misc_feature (671)..(671): C,T
  misc_feature (887)..(887): A, G
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacgcttaggcctgaccatctggtgctggcctgyaccagggccgagtttgggtctagcgatgaggataccgattgaggtgggtaaggtgggcgtggctagmagggtggggcgtgtataaattgggggtctaagggtctctctgttttgtcttgcaacagccgccgccatgagcgacaccggcaacagctttgatggaagcatctttagcccctatytgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcrgcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaagctctagagcgcggccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgcacgtcggagtataccggggtaccccgacgccgcgtaactataacggtcctaaggtagcgaaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 93 - DNA, 36759 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacagggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatctttctagctagtctagactagctagactcgagagcggccgcaatcgataagcttgatatcgaattctgcagtgatcagggatcctcatcagttggagaaggcgatgttgttgatgccggacagctggtccttggacagggtcacgggggtggatctggccttacagtacagcagcaggcccacagcaatcagagacagcaggatcacaatgatcacgatgatgattgtggtgatcatgatgttggtggtgctcttgccggcattcacattgtgcagcagctcgtcgctcttcctgatgaaggccaggctctggttgatcttctcgttcacctggctgatgctggcatcgaactcgtcgctagggaacaccagggggtcgtagaagttgatgatgggctcgcccttcacgtacaggctcttgccctcctgcttattcacgtagtacagtgtgttgcccacagacacggtgtccacgcccttgttggacacgtagtcacagccgttgctgaaggtcttgatgatcccccggttcttgttgctggcggtacacttggtcttgccgtagcaggacacgatggcgcccaggctggtaatcacgctgctggacacgtcggtcttggaggtcatgatcttacagtcgtacttggggttgaagatgtccacgttacacaggttcacctcgctgggcagggtcaggctgttcatggtgtcacagaacacccggttgctctgcaccttacaggtctcggcctgggggaagaaggacacgctgccggcattgtcacagtaccagcctctatcggtcctggtcaggcagatgttgctgccctccttggtgttggtggtacacagagggctggtgtgcagcttccagcaaggggtatcgatcacgccgtacaggggcagctgcaccacgtaggccagcacctcttccttgatgatgctcatgatgctgtagctctgctgcctcacaatctgcacgttgttgctcatcagctttttctggtcgttggtgatgggcatgtcattgatcagggacagcagctcgctgttggtcagcatgtaggtgctcacaggggtggtcacgccggcgttcacgctgaactccctggtgatctccagcagccggttgttcttctgctggaactcgatcacggtctcgatgttgctgatggagcagctctgcttgttcacgatgggcagcagctgcttgtcgatgtagttcttcagatccagcaccttgctggtcagcacggacacgccgttgctcagggacaccacggccttgttggtggacagcagggcgctcttgatcttgttcacctcgccctccaggtgcagcaccttagacacggccactccgctggcgatggcgctgcccactcccagcaggaagcccaggaatctccgcttccgcttcttgctcagggtcacgttggttttcttggcgttgttcagggtgtagttcatgaaccggggcagctcgcgcctggctctgttgttggtggcgggggtgctctgcatcagcagctgcagctcggtcacggcgttcttgtacttgtccagctcctgcttgatcagcttcaccttggcgtcggtgccgttacacttgttttccttgatgttggacagctcgatggtgatcacgctggtgtaccagccggttctcagggcgctcaggtagcccttggacacggcgctacaggtgctctggtagaactcctcggtgatattctggccgctggcgaagcagaaggtcacggcggtcaggatggtggtgatggcgttggccttcaggatcagcagctccatggtggcgtcgacggtaccggctgcagttggacctgggagtggacacctgtggagagaaaggcaaagtggatgtcattgtcactcaagtgtatggccagatctcaagcctgccacacctcaagtgaagccaagggggtgggcctatagactctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctcgtcgacgatctctatcactgatagggagatctctatcactgatagggagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtgcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaagctctagagcgcggccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgcacgtcggagtataccggggtaccccgacgccgcgtaactataacggtcctaaggtagcgaaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 94 - DNA, 36759 bp, Gorilla beringei graueri
  misc_feature (3387)..(3387): C,T
  misc_feature (3569)..(3569): C,T
  misc_feature (3785)..(3785): A, G
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacagggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatctttctagctagtctagactagctagactcgagagcggccgcaatcgataagcttgatatcgaattctgcagtgatcagggatcctcatcagttggagaaggcgatgttgttgatgccggacagctggtccttggacagggtcacgggggtggatctggccttacagtacagcagcaggcccacagcaatcagagacagcaggatcacaatgatcacgatgatgattgtggtgatcatgatgttggtggtgctcttgccggcattcacattgtgcagcagctcgtcgctcttcctgatgaaggccaggctctggttgatcttctcgttcacctggctgatgctggcatcgaactcgtcgctagggaacaccagggggtcgtagaagttgatgatgggctcgcccttcacgtacaggctcttgccctcctgcttattcacgtagtacagtgtgttgcccacagacacggtgtccacgcccttgttggacacgtagtcacagccgttgctgaaggtcttgatgatcccccggttcttgttgctggcggtacacttggtcttgccgtagcaggacacgatggcgcccaggctggtaatcacgctgctggacacgtcggtcttggaggtcatgatcttacagtcgtacttggggttgaagatgtccacgttacacaggttcacctcgctgggcagggtcaggctgttcatggtgtcacagaacacccggttgctctgcaccttacaggtctcggcctgggggaagaaggacacgctgccggcattgtcacagtaccagcctctatcggtcctggtcaggcagatgttgctgccctccttggtgttggtggtacacagagggctggtgtgcagcttccagcaaggggtatcgatcacgccgtacaggggcagctgcaccacgtaggccagcacctcttccttgatgatgctcatgatgctgtagctctgctgcctcacaatctgcacgttgttgctcatcagctttttctggtcgttggtgatgggcatgtcattgatcagggacagcagctcgctgttggtcagcatgtaggtgctcacaggggtggtcacgccggcgttcacgctgaactccctggtgatctccagcagccggttgttcttctgctggaactcgatcacggtctcgatgttgctgatggagcagctctgcttgttcacgatgggcagcagctgcttgtcgatgtagttcttcagatccagcaccttgctggtcagcacggacacgccgttgctcagggacaccacggccttgttggtggacagcagggcgctcttgatcttgttcacctcgccctccaggtgcagcaccttagacacggccactccgctggcgatggcgctgcccactcccagcaggaagcccaggaatctccgcttccgcttcttgctcagggtcacgttggttttcttggcgttgttcagggtgtagttcatgaaccggggcagctcgcgcctggctctgttgttggtggcgggggtgctctgcatcagcagctgcagctcggtcacggcgttcttgtacttgtccagctcctgcttgatcagcttcaccttggcgtcggtgccgttacacttgttttccttgatgttggacagctcgatggtgatcacgctggtgtaccagccggttctcagggcgctcaggtagcccttggacacggcgctacaggtgctctggtagaactcctcggtgatattctggccgctggcgaagcagaaggtcacggcggtcaggatggtggtgatggcgttggccttcaggatcagcagctccatggtggcgtcgacggtaccggctgcagttggacctgggagtggacacctgtggagagaaaggcaaagtggatgtcattgtcactcaagtgtatggccagatctcaagcctgccacacctcaagtgaagccaagggggtgggcctatagactctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctcgtcgacgatctctatcactgatagggagatctctatcactgatagggagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtgcttaggcctgaccatctggtgctggcctgyaccagggccgagtttgggtctagcgatgaggataccgattgaggtgggtaaggtgggcgtggctagmagggtggggcgtgtataaattgggggtctaagggtctctctgttttgtcttgcaacagccgccgccatgagcgacaccggcaacagctttgatggaagcatctttagcccctatytgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcrgcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaagctctagagcgcggccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgcacgtcggagtataccggggtaccccgacgccgcgtaactataacggtcctaaggtagcgaaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 95 - DNA, 34071 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtacacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacaaatcgggggcggagggtcccggactgggggatgatggtgccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagtctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtctccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcaccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaagcaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgttgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgcgagaaggcgttgagcccgccctcgttccagacccggctgtagaccacgcccccctcggcgttgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggttttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgagaagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcactcagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgccgtggccccgcgggcacgaaggcgcgcggccgccgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagaggaaaatcaggtggtcgctgcagatgatgaacttgaagatgaagaagcgcaagctcaagaggacgccccagctaaaaaaattcatgtatatgcccaggcgcctcttgctggcgaaaagattaccaaggatggtttgcaaataggtactgaagttgtaggagatacatctaaggacacttttgcagacaaaacattccaacccgaacctcagataggcgagtctcagtggaacgaggctgatgccacagtagcaggaggcagagtcttgaaaaaaaccacccctatgagaccttgctatggatcctatgccaggcctacaaatgccaacgggggtcaaggaattatggttgccaatgaacaaggagtgttggagtctaaagtggagatgcaatttttttctaacactacaacccttaatgcgcgggatggagctggcaatcccgaaccaaaggtggtgttgtacagtgaagatgtccacttggaatctcctgacactcatttgtcttacaagcccaaaaaggatgatgttaatgctaaaattatgttgggtcagcaagctatggctaacaggcccaacctcattgcttttagagataatttcattggactcatgtactacaacagcactggtaacatgggagtgctggcgggtcaggcctctcagttgaatgccgtggtggacctgcaggatagaaacacagaactgtcatatcagcttatgcttgattccattggggatagatccagatacttctccatgtggaaccaggcagtggatagctatgacccagatgtcagaatcattgaaaaccatggtgtcgaggacgagctacccaactactgcttccctctgggcggcataggaattactgatacttatcaagggatcaaaaataccaatggcaatggtcagtggaccaaagatgatcagttcgcggaccgtaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaagaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaacaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggctcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattacgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgtggcccgtctgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagctccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagacgcttctttgggggcgcgcgcgtcagcggcggcggagacggggacggggacggggacgggacgccctccacagggggtggtcttcgcgcagacccgcggccgcgctcgggggtcttttcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggaccccccagccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctcaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagattttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgagaaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggcctcctcgccagggtataactcacctggagatccgaggcagaggtattcagctcaacgacgagtcggtgagctcctcgctcggtctaagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaacgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaaacgctttcacgcttgattgctaacaccgggtttttatccgcagaatgattggaatcaccctactaatcacctccctccttgcgattgcccatgggttggaacgaatcgaagcccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatctaaccttgattgatgttcaaatgctggatgcgggctactattatgggcagctgggtacaatgattaattactggagaccccacaaagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgcctttgctgaggatttggaagaccacgaggaagatgagcatgacttcgcagatgcatgccaggcatcagaggcagaagcgctgccggtggccctcaaacagtatgcagacccccacaccacccccaaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccagaagttcgccctcatgataggcgaacaacccatcaccgtgacccagcactccgtggagacagaaggctgcatacacgctccctgtaggggcgctgactgcctctacaccttgatcaaaaccctctgcggtctcagagacctcatcccttttaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagacatgcaagcgcccattagctctcgagatggaaaactggctctaacagtggcggcccccctaactgtggtcgagggtatcaatgctttggcagtagccacaggtaagggtattgggctaaatgaaaccaacacacacctgcaggcaaaactggtcgcacccctaggctttgataccaacggcaacattaagctaagcgttgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatataacatcttctaacaaccaaaacggtctagaagccaacattaaactaacaagaggccttgtgtatgacggaaatgccatagcagttaatgttggcaaagggctggaatacagccctactgacacaacagaaaaacctatacagactaaaataggtctaggcatggagtatgataccgagggagccatgatgacaaaactaggctctggactaagctttgacaattcaggagccattgtagtgggaaacaaaaatgatgacaggcttactttgtggaccacaccggacccatcgcccaactgtcagatctactctgaaaaagatgctaaactaaccttggtactgactaaatgtggcagtcaggttgtaggcacagtatctattgccgctcttaaaggtagcctcgtgccaatcactagtgcaatcagtgtggttcaggtatacctaaggtttgatgaaaatggggtactaatgagtaactcttcacttaatggcgaatactggaattttagaaacggagactcaactaatggcacaccatatacaaacgcagtgggtttcatgcctaatctactggcctatcctaaaggtcaaactacaactgcaaaaagtaacattgtcagccaggtctacatgaatggggacgatactaaacccatgacatttacaatcaacttcaatggccttagtgaaacaggggatacccctgttagtaaatattccatgacattctcatggaggtggccaaatggaagctacatagggcacaattttgtaacaaactcctttaccttctcctacatcgcccaagaataaagaaagcacagagatgcttgtttttgatttcaaaattgtgtgcttttatttattttcagcttacagtatttccagtagtcattcaaataaagcttaatcaaactgcatgagaacccttccacatagcttaaattagcaccagtgcaaatggagaaaacaattgacggccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgccagtgtgatggatatctgcagaattccagcacactggcggccgttactagtggatccgagctcggtaccaacgcgtcgtaactataacggtcctaaggtagcgaaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacggtacgtcacttccgcaagaaaagcaaaactacatttcccacatgtgtaaaaacgaaaccccgccccttgtaaccgcccacaacttacatcatcaaaacgtaaactcctacgtcacccgccccgcctctccccgcccacctcattatcatattggccacaatccaaaataaggtatattattgatgatg

SEQ ID NO: 96 - DNA, 36968 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacagggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatctttctagctagtctagactagctagactcgagagcggccgcaatcgataagcttgatatcgaattctgcagtgatcagggatcctcatcagttggagaaggcgatgttgttgatgccggacagctggtccttggacagggtcacgggggtggatctggccttacagtacagcagcaggcccacagcaatcagagacagcaggatcacaatgatcacgatgatgattgtggtgatcatgatgttggtggtgctcttgccggcattcacattgtgcagcagctcgtcgctcttcctgatgaaggccaggctctggttgatcttctcgttcacctggctgatgctggcatcgaactcgtcgctagggaacaccagggggtcgtagaagttgatgatgggctcgcccttcacgtacaggctcttgccctcctgcttattcacgtagtacagtgtgttgcccacagacacggtgtccacgcccttgttggacacgtagtcacagccgttgctgaaggtcttgatgatcccccggttcttgttgctggcggtacacttggtcttgccgtagcaggacacgatggcgcccaggctggtaatcacgctgctggacacgtcggtcttggaggtcatgatcttacagtcgtacttggggttgaagatgtccacgttacacaggttcacctcgctgggcagggtcaggctgttcatggtgtcacagaacacccggttgctctgcaccttacaggtctcggcctgggggaagaaggacacgctgccggcattgtcacagtaccagcctctatcggtcctggtcaggcagatgttgctgccctccttggtgttggtggtacacagagggctggtgtgcagcttccagcaaggggtatcgatcacgccgtacaggggcagctgcaccacgtaggccagcacctcttccttgatgatgctcatgatgctgtagctctgctgcctcacaatctgcacgttgttgctcatcagctttttctggtcgttggtgatgggcatgtcattgatcagggacagcagctcgctgttggtcagcatgtaggtgctcacaggggtggtcacgccggcgttcacgctgaactccctggtgatctccagcagccggttgttcttctgctggaactcgatcacggtctcgatgttgctgatggagcagctctgcttgttcacgatgggcagcagctgcttgtcgatgtagttcttcagatccagcaccttgctggtcagcacggacacgccgttgctcagggacaccacggccttgttggtggacagcagggcgctcttgatcttgttcacctcgccctccaggtgcagcaccttagacacggccactccgctggcgatggcgctgcccactcccagcaggaagcccaggaatctccgcttccgcttcttgctcagggtcacgttggttttcttggcgttgttcagggtgtagttcatgaaccggggcagctcgcgcctggctctgttgttggtggcgggggtgctctgcatcagcagctgcagctcggtcacggcgttcttgtacttgtccagctcctgcttgatcagcttcaccttggcgtcggtgccgttacacttgttttccttgatgttggacagctcgatggtgatcacgctggtgtaccagccggttctcagggcgctcaggtagcccttggacacggcgctacaggtgctctggtagaactcctcggtgatattctggccgctggcgaagcagaaggtcacggcggtcaggatggtggtgatggcgttggccttcaggatcagcagctccatggtggcgtcgacggtaccggctgcagttggacctgggagtggacacctgtggagagaaaggcaaagtggatgtcattgtcactcaagtgtatggccagatctcaagcctgccacacctcaagtgaagccaagggggtgggcctatagactctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctcgtcgacgatctctatcactgatagggagatctctatcactgatagggagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtacacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacaaatcgggggcggagggtcccggactgggggatgatggtgccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagtctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtctccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcaccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaagcaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgttgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgcgagaaggcgttgagcccgccctcgttccagacccggctgtagaccacgcccccctcggcgttgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggttttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgagaagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcactcagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgccgtggccccgcgggcacgaaggcgcgcggccgccgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagaggaaaatcaggtggtcgctgcagatgatgaacttgaagatgaagaagcgcaagctcaagaggacgccccagctaaaaaaattcatgtatatgcccaggcgcctcttgctggcgaaaagattaccaaggatggtttgcaaataggtactgaagttgtaggagatacatctaaggacacttttgcagacaaaacattccaacccgaacctcagataggcgagtctcagtggaacgaggctgatgccacagtagcaggaggcagagtcttgaaaaaaaccacccctatgagaccttgctatggatcctatgccaggcctacaaatgccaacgggggtcaaggaattatggttgccaatgaacaaggagtgttggagtctaaagtggagatgcaatttttttctaacactacaacccttaatgcgcgggatggagctggcaatcccgaaccaaaggtggtgttgtacagtgaagatgtccacttggaatctcctgacactcatttgtcttacaagcccaaaaaggatgatgttaatgctaaaattatgttgggtcagcaagctatggctaacaggcccaacctcattgcttttagagataatttcattggactcatgtactacaacagcactggtaacatgggagtgctggcgggtcaggcctctcagttgaatgccgtggtggacctgcaggatagaaacacagaactgtcatatcagcttatgcttgattccattggggatagatccagatacttctccatgtggaaccaggcagtggatagctatgacccagatgtcagaatcattgaaaaccatggtgtcgaggacgagctacccaactactgcttccctctgggcggcataggaattactgatacttatcaagggatcaaaaataccaatggcaatggtcagtggaccaaagatgatcagttcgcggaccgtaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaagaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaacaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggctcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattacgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgtggcccgtctgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagctccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagacgcttctttgggggcgcgcgcgtcagcggcggcggagacggggacggggacggggacgggacgccctccacagggggtggtcttcgcgcagacccgcggccgcgctcgggggtcttttcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggaccccccagccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctcaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagattttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgagaaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggcctcctcgccagggtataactcacctggagatccgaggcagaggtattcagctcaacgacgagtcggtgagctcctcgctcggtctaagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaacgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaaacgctttcacgcttgattgctaacaccgggtttttatccgcagaatgattggaatcaccctactaatcacctccctccttgcgattgcccatgggttggaacgaatcgaagcccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatctaaccttgattgatgttcaaatgctggatgcgggctactattatgggcagctgggtacaatgattaattactggagaccccacaaagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgcctttgctgaggatttggaagaccacgaggaagatgagcatgacttcgcagatgcatgccaggcatcagaggcagaagcgctgccggtggccctcaaacagtatgcagacccccacaccacccccaaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccagaagttcgccctcatgataggcgaacaacccatcaccgtgacccagcactccgtggagacagaaggctgcatacacgctccctgtaggggcgctgactgcctctacaccttgatcaaaaccctctgcggtctcagagacctcatcccttttaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagacatgcaagcgcccattagctctcgagatggaaaactggctctaacagtggcggcccccctaactgtggtcgagggtatcaatgctttggcagtagccacaggtaagggtattgggctaaatgaaaccaacacacacctgcaggcaaaactggtcgcacccctaggctttgataccaacggcaacattaagctaagcgttgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatataacatcttctaacaaccaaaacggtctagaagccaacattaaactaacaagaggccttgtgtatgacggaaatgccatagcagttaatgttggcaaagggctggaatacagccctactgacacaacagaaaaacctatacagactaaaataggtctaggcatggagtatgataccgagggagccatgatgacaaaactaggctctggactaagctttgacaattcaggagccattgtagtgggaaacaaaaatgatgacaggcttactttgtggaccacaccggacccatcgcccaactgtcagatctactctgaaaaagatgctaaactaaccttggtactgactaaatgtggcagtcaggttgtaggcacagtatctattgccgctcttaaaggtagcctcgtgccaatcactagtgcaatcagtgtggttcaggtatacctaaggtttgatgaaaatggggtactaatgagtaactcttcacttaatggcgaatactggaattttagaaacggagactcaactaatggcacaccatatacaaacgcagtgggtttcatgcctaatctactggcctatcctaaaggtcaaactacaactgcaaaaagtaacattgtcagccaggtctacatgaatggggacgatactaaacccatgacatttacaatcaacttcaatggccttagtgaaacaggggatacccctgttagtaaatattccatgacattctcatggaggtggccaaatggaagctacatagggcacaattttgtaacaaactcctttaccttctcctacatcgcccaagaataaagaaagcacagagatgcttgtttttgatttcaaaattgtgtgcttttatttattttcagcttacagtatttccagtagtcattcaaataaagcttaatcaaactgcatgagaacccttccacatagcttaaattagcaccagtgcaaatggagaaaacaattgacggccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgccagtgtgatggatatctgcagaattccagcacactggcggccgttactagtggatccgagctcggtaccaacgcgtcgtaactataacggtcctaaggtagcgaaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacggtacgtcacttccgcaagaaaagcaaaactacatttcccacatgtgtaaaaacgaaaccccgccccttgtaaccgcccacaacttacatcatcaaaacgtaaactcctacgtcacccgccccgcctctccccgcccacctcattatcatattggccacaatccaaaataaggtatattattgatgatg

SEQ ID NO: 97 - DNA, 33485 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtacacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacaaatcgggggcggagggtcccggactgggggatgatggtgccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagtctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtctccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcaccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaagcaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgttgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgcgagaaggcgttgagcccgccctcgttccagacccggctgtagaccacgcccccctcggcgttgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggttttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgagaagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcactcagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgccgtggccccgcgggcacgaaggcgcgcggccgccgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagaggaaaatcaggtggtcgctgcagatgatgaacttgaagatgaagaagcgcaagctcaagaggacgccccagctaaaaaaattcatgtatatgcccaggcgcctcttgctggcgaaaagattaccaaggatggtttgcaaataggtactgaagttgtaggagatacatctaaggacacttttgcagacaaaacattccaacccgaacctcagataggcgagtctcagtggaacgaggctgatgccacagtagcaggaggcagagtcttgaaaaaaaccacccctatgagaccttgctatggatcctatgccaggcctacaaatgccaacgggggtcaaggaattatggttgccaatgaacaaggagtgttggagtctaaagtggagatgcaatttttttctaacactacaacccttaatgcgcgggatggagctggcaatcccgaaccaaaggtggtgttgtacagtgaagatgtccacttggaatctcctgacactcatttgtcttacaagcccaaaaaggatgatgttaatgctaaaattatgttgggtcagcaagctatggctaacaggcccaacctcattgcttttagagataatttcattggactcatgtactacaacagcactggtaacatgggagtgctggcgggtcaggcctctcagttgaatgccgtggtggacctgcaggatagaaacacagaactgtcatatcagcttatgcttgattccattggggatagatccagatacttctccatgtggaaccaggcagtggatagctatgacccagatgtcagaatcattgaaaaccatggtgtcgaggacgagctacccaactactgcttccctctgggcggcataggaattactgatacttatcaagggatcaaaaataccaatggcaatggtcagtggaccaaagatgatcagttcgcggaccgtaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaagaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaacaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggctcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattacgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgtggcccgtctgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagctccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagacgcttctttgggggcgcgcgcgtcagcggcggcggagacggggacggggacggggacgggacgccctccacagggggtggtcttcgcgcagacccgcggccgcgctcgggggtcttttcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggaccccccagccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctcaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagattttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgagaaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggcctcctcgccagggtataactcacctggagatccgaggcagaggtattcagctcaacgacgagtcggtgagctcctcgctcggtctaagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaacgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaaacgctttcacgcttgattgctaacaccgggtttttatccgcagaatgattggaatcaccctactaatcacctccctccttgcgattgcccatgggttggaacgaatcgaagcccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatctaaccttgattgatgttcaaatgctggatgcgggctactattatgggcagctgggtacaatgattaattactggagaccccacaaagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgcctttgctgaggatttggaagaccacgaggaagatgagcatgacttcgcagatgcatgccaggcatcagaggcagaagcgctgccggtggccctcaaacagtatgcagacccccacaccacccccaaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccagaagttcgccctcatgataggcgaacaacccatcaccgtgacccagcactccgtggagacagaaggctgcatacacgctccctgtaggggcgctgactgcctctacaccttgatcaaaaccctctgcggtctcagagacctcatcccttttaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagacatgcaagcgcccattagctctcgagatggaaaactggctctaacagtggcggcccccctaactgtggtcgagggtatcaatgctttggcagtagccacaggtaagggtattgggctaaatgaaaccaacacacacctgcaggcaaaactggtcgcacccctaggctttgataccaacggcaacattaagctaagcgttgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatataacatcttctaacaaccaaaacggtctagaagccaacattaaactaacaagaggccttgtgtatgacggaaatgccatagcagttaatgttggcaaagggctggaatacagccctactgacacaacagaaaaacctatacagactaaaataggtctaggcatggagtatgataccgagggagccatgatgacaaaactaggctctggactaagctttgacaattcaggagccattgtagtgggaaacaaaaatgatgacaggcttactttgtggaccacaccggacccatcgcccaactgtcagatctactctgaaaaagatgctaaactaaccttggtactgactaaatgtggcagtcaggttgtaggcacagtatctattgccgctcttaaaggtagcctcgtgccaatcactagtgcaatcagtgtggttcaggtatacctaaggtttgatgaaaatggggtactaatgagtaactcttcacttaatggcgaatactggaattttagaaacggagactcaactaatggcacaccatatacaaacgcagtgggtttcatgcctaatctactggcctatcctaaaggtcaaactacaactgcaaaaagtaacattgtcagccaggtctacatgaatggggacgatactaaacccatgacatttacaatcaacttcaatggccttagtgaaacaggggatacccctgttagtaaatattccatgacattctcatggaggtggccaaatggaagctacatagggcacaattttgtaacaaactcctttaccttctcctacatcgcccaagaataaagaaagcacagagatgcttgtttttgatttcaaaattgtgtgcttttatttattttcagcttacagtatttccagtagtcattcaaataaagcttaatcaaactgcatgagaacccttccacatagcttaaattagcaccagtgcaaatggagaaaaatcaacatacctttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtcttatcctccgctgagtcgatcaaaaataacagctaaaccacaaacaacacgattggtcaaatgctccacaagggttacctgcagcagaaaattgcctcggaactccaccgcaagcagaacagcaaagccaccgcctctatcgtgatcaagaataaaaaccccacagctatccacttacagacccagatagttttcagctctccatcgtgaaaaaagatttacaagctcctcctttaaatcacctccaaccaattgaaaaagttgaaccagaccgccctccaccttcagtttcagcaagcgtttaattatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacaaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacggtacgtcacttccgcaagaaaagcaaaactacatttcccacatgtgtaaaaacgaaaccccgccccttgtaaccgcccacaacttacatcatcaaaacgtaaactcctacgtcacccgccccgcctctccccgcccacctcattatcatattggccacaatccaaaataaggtatattattgatgatg

SEQ ID NO: 98 - DNA, 36382 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacagggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatctttctagctagtctagactagctagactcgagagcggccgcaatcgataagcttgatatcgaattctgcagtgatcagggatcctcatcagttggagaaggcgatgttgttgatgccggacagctggtccttggacagggtcacgggggtggatctggccttacagtacagcagcaggcccacagcaatcagagacagcaggatcacaatgatcacgatgatgattgtggtgatcatgatgttggtggtgctcttgccggcattcacattgtgcagcagctcgtcgctcttcctgatgaaggccaggctctggttgatcttctcgttcacctggctgatgctggcatcgaactcgtcgctagggaacaccagggggtcgtagaagttgatgatgggctcgcccttcacgtacaggctcttgccctcctgcttattcacgtagtacagtgtgttgcccacagacacggtgtccacgcccttgttggacacgtagtcacagccgttgctgaaggtcttgatgatcccccggttcttgttgctggcggtacacttggtcttgccgtagcaggacacgatggcgcccaggctggtaatcacgctgctggacacgtcggtcttggaggtcatgatcttacagtcgtacttggggttgaagatgtccacgttacacaggttcacctcgctgggcagggtcaggctgttcatggtgtcacagaacacccggttgctctgcaccttacaggtctcggcctgggggaagaaggacacgctgccggcattgtcacagtaccagcctctatcggtcctggtcaggcagatgttgctgccctccttggtgttggtggtacacagagggctggtgtgcagcttccagcaaggggtatcgatcacgccgtacaggggcagctgcaccacgtaggccagcacctcttccttgatgatgctcatgatgctgtagctctgctgcctcacaatctgcacgttgttgctcatcagctttttctggtcgttggtgatgggcatgtcattgatcagggacagcagctcgctgttggtcagcatgtaggtgctcacaggggtggtcacgccggcgttcacgctgaactccctggtgatctccagcagccggttgttcttctgctggaactcgatcacggtctcgatgttgctgatggagcagctctgcttgttcacgatgggcagcagctgcttgtcgatgtagttcttcagatccagcaccttgctggtcagcacggacacgccgttgctcagggacaccacggccttgttggtggacagcagggcgctcttgatcttgttcacctcgccctccaggtgcagcaccttagacacggccactccgctggcgatggcgctgcccactcccagcaggaagcccaggaatctccgcttccgcttcttgctcagggtcacgttggttttcttggcgttgttcagggtgtagttcatgaaccggggcagctcgcgcctggctctgttgttggtggcgggggtgctctgcatcagcagctgcagctcggtcacggcgttcttgtacttgtccagctcctgcttgatcagcttcaccttggcgtcggtgccgttacacttgttttccttgatgttggacagctcgatggtgatcacgctggtgtaccagccggttctcagggcgctcaggtagcccttggacacggcgctacaggtgctctggtagaactcctcggtgatattctggccgctggcgaagcagaaggtcacggcggtcaggatggtggtgatggcgttggccttcaggatcagcagctccatggtggcgtcgacggtaccggctgcagttggacctgggagtggacacctgtggagagaaaggcaaagtggatgtcattgtcactcaagtgtatggccagatctcaagcctgccacacctcaagtgaagccaagggggtgggcctatagactctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctcgtcgacgatctctatcactgatagggagatctctatcactgatagggagagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtacacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataggacatctttacaaatcgggggcggagggtcccggactgggggatgatggtgccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagtctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtctccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcaccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtccggaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaagcaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgttgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacaggcatgggcggcaggggcacgtcttcgccgcgcgcgggcaggggctggtgctggctccgaagagcgcttgcgtgcgcgacgacgcgacggttggtgtcctgtatctgacgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcttcctggagatctcctcgtccggcgcgctccacggtggccgccaggtcgttggagatgcgacccatgagctgcgagaaggcgttgagcccgccctcgttccagacccggctgtagaccacgcccccctcggcgttgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacaccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggttttccagcatgaggcggtggtatccgtagatgtacctggacatccaggtgatgccggcggcggtggtggtggcgcgcgcgtagtcgcggacccggttccagatgtttcgcaggggcgagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttgaatcggccggaaccgcggctaacgagggccgtggcagccccgtcctcaggaccccgccagccgacttctccagttacgggagcgagccccttttgttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggccgatgaccaggaagaggaggactatgagctagaggagggcgagtacctggaggactgacctggctggtggtgttttggtatagatgcaagatccgaacgtggcggacccggcggtccgggcggcgctgcaaagccagccgtccggcattaactcctctgacgactgggccgcggccatgggtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggacgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttcaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggagacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacccaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcatcaaccgcctgatggactacttgcatcgggcggcggccgtgaaccccgagtacttcactaatgccattctgaatccccactggatgccccctccgggtttctacaacggggactttgaggtgcccgaggtcaacgacgggttcctctgggatgacatggatgacagtgtgttctcacccaacccgctgcgcgccgcgtctctgcgattgaaggagggctctgacagggaaggaccgagaagtctggcctcctccctggctctgggagcggtgggcgccacgggcgcggcggcgcggggcagtagccccttccccagcctggcagactctctgaacagcgggcgggtgagcaggccccgcttgctaggcgaggaggagtatctgaacaactccctgctgcagcccgcgagggacaagaacgctcagcggcagcagtttcccaacaatgggatagagagcctggtggacaagatgtccagatggaagacgtatgcgcaggagtacaaggagtgggaggaccgccagccgcggcccttgccgccccctaggcagcgctggcagcggcgcgcgtccaaccgccgctggaggcaggggcccgaggacgatgatgactctgcagatgacagcagcgtgttggacctgggcgggagcgggaaccccttttcgcacctgcgcccacgcctgggcaagatgttttaaaagaaaaaaaaaaaataaaactcaccaaggccatggcgacgagcgttggttttttgttcccttccttagtatgcggcgcgcggcgatgttcgaggaggggcctcccccctcttacgagagcgcgatggggatttctcctgcggcgcccctgcagcctccctacgtgcctcctcggtacctgcaacctacaggggggagaaatagcatctgttactctgagctgcagcccctgtacgataccaccagactgtacctggtggacaacaagtccgcggacgtggcctccctgaactaccagaacgaccacagcgattttttgaccacggtgatccaaaacaacgacttcaccccaaccgaggccagcactcagaccataaacctggataacaggtcgaactggggcggcgacctgaagaccatcttgcacaccaacatgcccaacgtgaacgagttcatgttcaccaactcttttaaggcgcgggtgatggtggcgcgcgagcagggggaggcgaagtacgagtgggtggacttcacgctgcccgagggcaactactcagagaccatgactctcgacctgatgaacaatgcgatcgtggaacactatctgaaagtgggcaggcagaacggggtgaaggaaagcgatatcggggtcaagtttgacaccagaaacttccgtctgggctgggaccccgtgaccgggctggtcatgccgggggtctacaccaacgaggcctttcatcccgacatagtgcttctgcccggctgtggggtggacttcacccagagccggctgagcaacctgctgggcattcgcaagcggcagcctttccaggagggtttcaagatcacctatgaggatctgaaggggggcaacattcccgcgctccttgatctggacgcctacgaggagagcttgaaacccgaggagagcgctggcgacagcggcgagagtggcgaggagcaagccggcggcggtggcggcgcgtcggtagaaaacgaaagtacgcccgcagtggcggcggacgctgcggaggtcgagccggaggccatgcagcaggacgcagaggagggcgcacaggagggcgcgcagaaggacatgaacgatggggagatcaggggagacacattcgccacccggggcgaagaaaaagaggcagaggcggcggcggcggcgacggcggaggccgaaaccgaggttgaggcagaggcagagcccgagaccgaagttatggaagacatgaatgatggagaacgtaggggcgacacgttcgccacccggggcgaagagaaggcggcggaggcagaagccgcggctgaggaggcggctgcggctgcggccaagactgaggctgcggctaaggctgaggtcgaagccaatgttgcggttgaggctcaggctgaggaggaggcggcggctgaagcagttaaggaaaaggcccaggcagagcaggaagagaaaaaacctgtcattcaacctctaaaagaagatagcaaaaagcgcagttacaacgtcatcgagggcagcacctttacccagtaccgcagctggtacctggcgtacaactacggcgacccggtcaagggggtgcgctcgtggaccctgctctgcacgccggacgtcacctgcggctccgagcagatgtactggtcgctgccgaacatgatgcaagacccggtgaccttccgctccacgcggcaggttagcaacttcccggtggtgggcgccgaactgctgcccgtgcactccaagagtttttacaacgagcaggccgtctactcccagctgatccgccaggccacctctctgacccacgtgttcaatcgctttcccgagaaccagattttggcgcgcccgccggcccccaccatcaccaccgtgagtgaaaacgttcctgccctcacagatcacgggacgctaccgctgcgcaacagcatctcaggagtccagcgagtgaccattactgacgccagacgccggacctgcccctacgtttacaaggccttgggcatagtctcgccgcgcgtcctctccagtcgcactttttaaaacacatctacccacacgttccaaaatcatgtccgtactcatctcacccagcaacaacaccggctgggggctgcgcgcgcccagcaagatgtttggaggggcgaggaagcgctccgaccagcaccctgtgcgcgtgcgcggccactaccgcgcgccctggggagcgcacaagcgcgggcgcacagggcgcaccactgtggacgacgtcattgactccgtagtggagcaagcgcgccactacacacccggcgcgccgaccgcccccgccgtgtccaccgtggaccaggcgatcgaaagcgtggtacagggcgcgcggcactatgccaaccttaaaagtcgccgccgccgcgtggcccgccgccatcgccggagaccccgggccaccgccgccgcgcgccttactaaggctctgctcaggcgcgccaggcgaactggccaccgggccgccatgagggccgcacggcgggctgccgctgccgcaagcgccgtggccccgcgggcacgaaggcgcgcggccgccgccgccgccgccgccatttccagcttggcctcgacgcggcgcggtaacatatactgggtgcgcgactcggtaaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggccggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtaaccctgcaacaggtgctgcctttgagcgcgcccagcgagcataagcgagggttgaagcgcgaaggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcggcggccagcgccaccaccggcaccgcttcggtagaggtgcagacggacccctggctacccgccaccgctgttgccgccgccgccccccgttcgcgcgggcgcaagagaaattatccagcggccagcgcgctcatgccccagtacgcactgcatccatccatcgcgcccacccccggctaccgcgggtactcgtaccgcccgcgcagatcagccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcattttttggaggaaaaataaaaaaagtctagactctcacgctcgcttggtcctgtgactattttgtagaaaaaagatggaagacatcaactttgcgtcgctggccccgcgtcacggctcgcgcccgttcatgggagactggacagatatcggcaccagcaatatgagcggtggcgccttcagctggggcagtctgtggagcggccttaaaaattttggttccaccattaagaactatggcaacaaagcgtggaacagcagcacgggccagatgctgagagacaagttgaaagagcagaacttccaggagaaggtggcgcagggcctggcctctggcatcagcggggtggtggacatagctaaccaggccgtgcagaaaaagataaacagtcatctggacccccgtcctcaggtggaggaaatgcctccagcgatggagacggtgtctcccgagggcaaaggcgaaaagcgcccgcggcccgacagagaagagaccctggtgtcacacaccgaggagccgccctcttacgaggaggcagtcaaggccggcctgcccaccactcgccccatagcccccatggccaccggtgtggtgggccacaggcaacacactcccgcaacactagatctgcccccgccgtccgagccgccgcgccagccaaaggcggcgacggtgcccgctccctccacttccgccgccaacagagtgcccctgcgccgcgccgcgagcggcccccgggcctcgcgagttagcggcaactggcagagcacactgaacagcatcgtgggcctgggagtgaggagtgtgaagcgccgccgttgctactgaatgagcaagctagctaacgtgttgtatgtgtgtatgcgtcctatgtcgccgccagaggagctgttgagccgccggcgccgtctgcactccagcgaatttcaagatggcgaccccatcgatgatgcctcagtggtcgtacatgcacatctcgggccaggacgcttcggagtacctgagccccgggctggtgcagttcgcccgcgccacagacacctacttcaacatgagtaacaagttcaggaaccccactgtggcgcccacccacgatgtgaccacggaccggtcgcagcgcctgacgctgcggttcatccccgtggatcgggaggacaccgcctactcttacaaggcgcggttcacgctggccgtgggcgacaaccgcgtgctggacatggcctccacttactttgacatcaggggggtgctggacaggggccccaccttcaagccctactcgggtactgcctacaactccctggcccccaagggcgctcccaattcttgcgagtgggaacaagaggaaaatcaggtggtcgctgcagatgatgaacttgaagatgaagaagcgcaagctcaagaggacgccccagctaaaaaaattcatgtatatgcccaggcgcctcttgctggcgaaaagattaccaaggatggtttgcaaataggtactgaagttgtaggagatacatctaaggacacttttgcagacaaaacattccaacccgaacctcagataggcgagtctcagtggaacgaggctgatgccacagtagcaggaggcagagtcttgaaaaaaaccacccctatgagaccttgctatggatcctatgccaggcctacaaatgccaacgggggtcaaggaattatggttgccaatgaacaaggagtgttggagtctaaagtggagatgcaatttttttctaacactacaacccttaatgcgcgggatggagctggcaatcccgaaccaaaggtggtgttgtacagtgaagatgtccacttggaatctcctgacactcatttgtcttacaagcccaaaaaggatgatgttaatgctaaaattatgttgggtcagcaagctatggctaacaggcccaacctcattgcttttagagataatttcattggactcatgtactacaacagcactggtaacatgggagtgctggcgggtcaggcctctcagttgaatgccgtggtggacctgcaggatagaaacacagaactgtcatatcagcttatgcttgattccattggggatagatccagatacttctccatgtggaaccaggcagtggatagctatgacccagatgtcagaatcattgaaaaccatggtgtcgaggacgagctacccaactactgcttccctctgggcggcataggaattactgatacttatcaagggatcaaaaataccaatggcaatggtcagtggaccaaagatgatcagttcgcggaccgtaatgaaataggggtgggaaacaacttcgccatggagatcaacatccaggccaacctctggaggaacttcctctatgcgaacgtggggctctacctgccagacaagctcaagtacaaccccaccaacgtggacatctctgacaaccccaacacctatgactacatgaacaagcgtgtggtggctcccggcctggtggactgctttgtcaatgtgggagccaggtggtccctggactacatggacaacgtcaaccccttcaaccaccaccgcaatgcgggtctgcgctaccgctccatgatcctgggcaacgggcgctacgtgcccttccacattcaggtgccccagaagttctttgccatcaagaacctcctcctcctgccgggctcctacacttacgagtggaacttcaggaaggatgtcaacatggtcctgcagagctctctgggcaatgaccttagggtggacggggccagcatcaagtttgacagcgtcaccctctatgctaccttcttccccatggctcacaacaccgcctccacgctcgaggccatgctgaggaacgacaccaacgaccagtccttcaatgactacctctctggggccaacatgctctaccccatccccgccaaggccaccaacgtgcccatctccattccctctcgcaactgggccgccttcagaggctgggcctttacccgccttaagaccaaggaaaccccctccctgggctcgggttttgacccctactttgtctactcgggatccatcccctacctggatggcaccttctacctcaaccacacttttaagaagatatccatcatgtatgactcctccgtcagctggccgggcaatgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccattggcatcactcaccagcacaacaactcgggattcgtgggctacctggctcccaccatgcgcgaggggcaggcctaccccgccaacttcccctacccgttgataggcaagaccgcggtcgacagcgtcacccagaaaaagttcctctgcgaccgcaccctctggcgcatccccttctctagcaacttcatgtccatgggtgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacctgctacctcttcgacccctttggcttctccgatcagcgcctcagacagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcacatccggggggccacctctttctgccacttgcaacaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggctcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattacgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgtggcccgtctgcgcctgcgggtacagcgcgcgcatgaaggcttcgatctgcctgaaagccacctgcgtcttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaatttttgtgggtcacccccgcgtaggcctgcaggtaggcctgcaagaagcgccccatcatggccacaaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagctccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagacgcttctttgggggcgcgcgcgtcagcggcggcggagacggggacggggacggggacgggacgccctccacagggggtggtcttcgcgcagacccgcggccgcgctcgggggtcttttcgagctggtcttggtcccgactggccattgtatcctcctcctcctaggcagagagacataaggagtctatcatgcaagtcgagaaggaggagagcttaaccaccccctctgagaccgccgatgcgcccgccgtcgccgtcgcccccgctgccgccgacgcgcccgccacaccgagcgacacccccgcggaccccccagccgacgcacccctgttcgaggaagcggccgtggagcaggacccgggctttgtctcggcagaggaggatttgcgagaggaggaggataaggagaagaagccctcagtgccaaaagatgataaagagcaagacgagcacgacgcagatgcacaccagggtgaagtcgggcggggggacggagggcatgacggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgcctttgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatcttcgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctcaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgcctggaggagcgcaacctcaaggagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaagaccaatcccgcccgcccaaggcggagctgaccgcctgcgtcatcacccagggcgagatcctaggccaattgcaagccatccaaaaagcccgccaagattttttgctgagaaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgagaaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcaattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggcctcctcgccagggtataactcacctggagatccgaggcagaggtattcagctcaacgacgagtcggtgagctcctcgctcggtctaagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctcgggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgaggaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgactttatagagccccagtgtaacgtgacttttaaagcccatgcacagcgttgtcatactataatcaaatgtgccaccgaacacgatgaataccttatccagtataaagataaatcacacaaagtggcacttgttgacatctggaaacccgaagaccctttggaatacaatgtgaccgttttccagggtgacctcttcaaaatttacaattacactttcccatttgaccagatgtgtgactttgtcatgtacatggaaaagcagcacaagctgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaaacgctttcacgcttgattgctaacaccgggtttttatccgcagaatgattggaatcaccctactaatcacctccctccttgcgattgcccatgggttggaacgaatcgaagcccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatctaaccttgattgatgttcaaatgctggatgcgggctactattatgggcagctgggtacaatgattaattactggagaccccacaaagattacatgctccacgtagtaaagggtccccttagcagcccacccactaccacctctactacccccactaccaccactactcccaccaccagcactgccgcccagcctcctcatagcagaacaaccacttttatcaattccaagtcccactccccccacattgccggcgggccctccgcctcagactccgagaccaccgagatctgcttctgcaaatgctctgacgcctttgctgaggatttggaagaccacgaggaagatgagcatgacttcgcagatgcatgccaggcatcagaggcagaagcgctgccggtggccctcaaacagtatgcagacccccacaccacccccaaccttcctccaccttcccagaagccaagtttcctgggggaaaatgaaactctgcctctctccatactcgctctgacatctgttgctatgttgaccgctctgctggtgcttctatgctctatatgctacctgatctgctgcagaaagaaaaaatctcacggccatgctcaccagcccctcatgcacttcccttaccctccagagctgggcgaccacaaactttaagtctgcagtaactatctgcccatcccttgtcagtcgacagcgatgagccccactaatctaacggcctctggacttacaacatcgtctcttaatgagaccaccgctcctcaagacctgtacgatggtgtctccgcgctggttaaccagtgggatcacctgggcatatggtggctcctcataggagcagtgaccctgtgcctaatcctggtctggatcatctgctgcatcaaaagcagaagacccaggcggcggcccatctacaggccctttgtcatcacacctgaagatgatgatgacaccacttccaggctgcagaggctaaagcagctactcttctcttttacagcatggtaaattgaatcatgcctcgcattttcatctacttgtctctccttccactttttctgggctcttctacattggccgctgtgtcccacatcgaggtagactgcctcacgcccttcacagtctacctgcttttcggctttgtcatctgcacctttgtctgcagcgttatcactgtagtgatctgcttcatacagtgcatcgactacgtctgcgtgcgggtggcttactttagacaccacccccagtatcgcaacagggacatagcggctctcctaagacttgtttaaaatcatggccaaattaactgtgattggtcttctgatcatctgctgcgtcctagccgcgattgggactcaagctcctaccaccaccagcgctcccagaaagagacatgtatcctgcagcttcaagcgtccctggaatataccccaatgctttactgatgaacctgaaatctctttggcttggtacttcagcgtcaccgcccttcttatcttctgcagtacggttattgcccttgccatctacccttcccttgacctgggctggaatgctgtcaactctatggaatatcccaccttcccagaaccagacctgccagacctggttgttctaaacgcgtttcctcctcctgctcccgttcaaaatcagtttcgccctccgtcccccacgcccactgaggtcagctactttaatctaacaggcggagatgactgaaaacctagacctagaaatggacggtctctgcagcgagcaacgcacactagagaggcgccggcaaaaagagctcgagcgtcttaaacaagagctccaagacgcggtggccatacaccagtgcaaaaaaggtgtcttctgtctggtaaaacaggccacgctcacctatgaaaaaacaggtgacacccaccgcctaggatacaagctgcccacacagcgccagaagttcgccctcatgataggcgaacaacccatcaccgtgacccagcactccgtggagacagaaggctgcatacacgctccctgtaggggcgctgactgcctctacaccttgatcaaaaccctctgcggtctcagagacctcatcccttttaattaatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtccctttccttacccctccctttgtgtcatccgcaggaatgcaagaaaatccagctggggtgctgtccctgcacttgtcagagccccttaccacccacaatggggccctgactctaaaaatggggggcggcctgaccctggacaaggaagggaatctcacttcccaaaacatcaccagtgtcgatccccctctcaaaaaaagcaagaacaacatcagccttcagaccgccgcacccctcgccgtcagctccggggccctaacactttttgccactccccccctagcggtcagtggtgacaaccttactgtgcagtctcaggcccctctcactttggaagactcaaaactaactctggccaccaaaggacccctaactgtgtccgaaggcaaacttgtcctagaaacagaggctcccctgcatgcaagtgacagcagcagcctgggccttagcgttacggccccacttagcattaacaatgacagcctaggactagacatgcaagcgcccattagctctcgagatggaaaactggctctaacagtggcggcccccctaactgtggtcgagggtatcaatgctttggcagtagccacaggtaagggtattgggctaaatgaaaccaacacacacctgcaggcaaaactggtcgcacccctaggctttgataccaacggcaacattaagctaagcgttgcaggaggcatgaggctaaacaataacacactgatactagatgtaaactacccatttgaggctcaaggccaactgagcctaagagtgggctcgggcccactatatgtagattctagtagtcataacctaaccattagatgccttaggggattgtatataacatcttctaacaaccaaaacggtctagaagccaacattaaactaacaagaggccttgtgtatgacggaaatgccatagcagttaatgttggcaaagggctggaatacagccctactgacacaacagaaaaacctatacagactaaaataggtctaggcatggagtatgataccgagggagccatgatgacaaaactaggctctggactaagctttgacaattcaggagccattgtagtgggaaacaaaaatgatgacaggcttactttgtggaccacaccggacccatcgcccaactgtcagatctactctgaaaaagatgctaaactaaccttggtactgactaaatgtggcagtcaggttgtaggcacagtatctattgccgctcttaaaggtagcctcgtgccaatcactagtgcaatcagtgtggttcaggtatacctaaggtttgatgaaaatggggtactaatgagtaactcttcacttaatggcgaatactggaattttagaaacggagactcaactaatggcacaccatatacaaacgcagtgggtttcatgcctaatctactggcctatcctaaaggtcaaactacaactgcaaaaagtaacattgtcagccaggtctacatgaatggggacgatactaaacccatgacatttacaatcaacttcaatggccttagtgaaacaggggatacccctgttagtaaatattccatgacattctcatggaggtggccaaatggaagctacatagggcacaattttgtaacaaactcctttaccttctcctacatcgcccaagaataaagaaagcacagagatgcttgtttttgatttcaaaattgtgtgcttttatttattttcagcttacagtatttccagtagtcattcaaataaagcttaatcaaactgcatgagaacccttccacatagcttaaattagcaccagtgcaaatggagaaaaatcaacatacctttttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtcttatcctccgctgagtcgatcaaaaataacagctaaaccacaaacaacacgattggtcaaatgctccacaagggttacctgcagcagaaaattgcctcggaactccaccgcaagcagaacagcaaagccaccgcctctatcgtgatcaagaataaaaaccccacagctatccacttacagacccagatagttttcagctctccatcgtgaaaaaagatttacaagctcctcctttaaatcacctccaaccaattgaaaaagttgaaccagaccgccctccaccttcagtttcagcaagcgtttaattatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacaaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaagagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacggtacgtcacttccgcaagaaaagcaaaactacatttcccacatgtgtaaaaacgaaaccccgccccttgtaaccgcccacaacttacatcatcaaaacgtaaactcctacgtcacccgccccgcctctccccgcccacctcattatcatattggccacaatccaaaataaggtatattattgatgatg

The invention claimed is:

1. An adenovirus or adenoviral vector comprising (1) a nucleic acid sequence encoding one or more Respiratory Syncytial Virus (RSV) antigens and (2) one or more of the nucleic acid sequences selected from the group consisting of:

(a) a nucleic acid sequence that is at least 97% identical to SEQ ID NO: 63,
   (b) a nucleic acid sequence that is at least 97.5% identical to SEQ ID NO: 64,
   (c) a nucleic acid sequence that is at least 80% identical to SEQ ID NO: 65,
   (d) a nucleic acid sequence that is at least 96% identical to SEQ ID NO: 66, and
   (e) a nucleic acid sequence that is at least 96% identical to SEQ ID NO: 67.

2. The adenovirus or adenoviral vector of claim 1, which comprises a nucleic acid sequence that is at least 97% identical to SEQ ID NO: 63.

3. The adenovirus or adenoviral vector of claim 2, which comprises the nucleic acid sequence of SEQ ID NO: 63.

4. The adenovirus or adenoviral vector of claim 1, which comprises a nucleic acid sequence that is at least 97.5% identical to SEQ ID NO: 64.

5. The adenovirus or adenoviral vector of claim 4, which comprises the nucleic acid sequence of SEQ ID NO: 64.

6. The adenovirus or adenoviral vector of claim 1, which comprises a nucleic acid sequence that is at least 80% identical to SEQ ID NO:65.

7. The adenovirus or adenoviral vector of claim 6, which comprises the nucleic acid sequence of SEQ ID NO: 65.

8. The adenovirus or adenoviral vector of claim 1, which comprises a nucleic acid sequence that is at least 96% identical to SEQ ID NO: 66.

9. The adenovirus or adenoviral vector of claim 8, which comprises the nucleic acid sequence of SEQ ID NO: 66.

10. The adenovirus or adenoviral vector of claim 1, which comprises a nucleic acid sequence that is at least 96% identical to SEQ ID NO: 67.

11. The adenovirus or adenoviral vector of claim 10, which comprises the nucleic acid sequence of SEQ ID NO: 67.

12. A method of inducing an immune response against RSV in a mammal, which comprises administering to the mammal the adenovirus or adenoviral vector of claim 1, whereupon the nucleic acid sequence encoding the RSV antigen is expressed in the mammal to produce the RSV antigen and thereby induce an immune response against RSV in the mammal.

13. A composition comprising the adenovirus or adenoviral vector of 1 and a pharmaceutically acceptable carrier.

14. A method of inducing an immune response against RSV in a mammal, which comprises administering to the mammal the composition of claim 13, whereupon the nucleic acid sequence encoding the RSV antigen is expressed in the mammal to produce the RSV antigen and thereby induce an immune response against RSV in the mammal.

* * * * *